United States Patent 8,394,390 (NEISSERIAL ANTIGENIC PEPTIDES) - sequence listing, part 5

SEQ ID NO: 39860 - DNA, 2121 bp, Neisseria meningitidis
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttccgggatgtttacgctggttgccgtactgcccggcgtgtttctgttcggcgtttccgcacagtttatcaacggcacgattaattcgtggttcggcaacgatacccacgaggcgcttgaacgcagcctcaatttgagcaagtccgcattgaatctggcggcagacaacgcccttggcaacgccatccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacaggcgggttcggtcagggatttggaaagcataggcggcgtattgtacgcgcagggctggctgtcggcaggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccagacattatctcgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcaaaacggctggcacacgaaatccgcaatccgctcacgcccatccagctttctgccgaacggctggcgtggaaattgggcgggaagctggacgagcaggacgcgcaaatcctgacacgttcgaccgacaccatcatcaaacaagtggcggcattaaaagaaatggtcgaggcattccgcaattacgcgcgttccccttcgctcaaattggaaaatcaggatttgaacgccttaatcggcgatgtgttggcattgtacgaagctggtccgtgccggtttgcggcggaacttgccggcgaaccgctgatgatggcggcggatacgaccgccatgcggcaggtgctgcacaatattttcaaaaatgccgccgaagcggcggaagaagccgatgtgcccgaagtcagggtaaaatcggaagcggggcaggacggacggattgtcctgacagtttgcgacaacggcaaggggttcggcagggaaatgctgcacaatgccttcgagccgtatgtaacggacaaaccggctggaacgggattgggactgcccgtggtgaaaaaaatcattgaagaacacggcggccgcatcagcctgagcaatcaggatgcgggcggcgcgtgtgtcagaatcatcttgccaaaaacggtagaaacttatgcgtag

SEQ ID NO: 39861 - protein, 706 aa, Neisseria meningitidis
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAIPVQIDLIGAASLPGDMGRVLEHYAGSGFAQLALYNAASGKIEKSINPHKLDQPFPGKARWEKIQQAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERLAWKLGGKLDEQDAQILTRSTDTIIKQVAALKEMVEAFRNYARSPSLKLENQDLNALIGDVLALYEAGPCRFAAELAGEPLMMAADTTAMRQVLHNIFKNAAEAAEEADVPEVRVKSEAGQDGRIVLTVCDNGKGFGREMLHNAFEPYVTDKPAGTGLGLPVVKKIIEEHGGRISLSNQDAGGACVRIILPKTVETYA

SEQ ID NO: 39862 - DNA, 651 bp, Neisseria gonorrhoeae
atgatgatgcacgcttctgtccaaagtcgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggtgcgttcaaaggctaaggcagaaaagttctaccgcgaaaaaatgatacagaacgaaagcatacaccccgtcctgcacgcttctttgcaacacttggaacacaagccgcaaatgctcgccctgctggtcaaaaaccacggcaaaggcatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatgggcgcgtgttcgccgatattttcgagttgtcggcggctttggaaaggcgcgcgttcaaagggatactgaaactgacggcggaatataaaaaacatcttcggcgatgcctgccgttcggaaacggcgttggatttgggcgcgctcaatcaggcgttgagggaaatctcgaaaacgccggaaaagcctaa

SEQ ID NO: 39863 - protein, 216 aa, Neisseria gonorrhoeae
MMMHASVQSRFAPILYVLIFFAGFLTAQIWFNQKAYTEELPPLLSALSAVALVWLAWAFVSVRSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALERRAFKGILKLTAEYKKHLRRCLPFGNGVGFGRAQSGVEGNLENAGKA

SEQ ID NO: 39864 - DNA, 641 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggccaaggcggaaaagttctaccgcgaaaaaatgatacagaacgaaagcatacaccccgtcstgcacgcctctttgcaacacttggaacacaagccgcaaatactcgccctgctggtcaaaaaccacggcaaagggatggcggaacaggtcaggttcaaggcggaagtgctgcccgacgacgaagacgcgcgcacgattgccgccgagttggcaaaaatggatatgttcgcattggggackgacgcggtcgcctcgggcgaaacctatggacgcgtgttcgccgatattttcgagttgtcggmggctttggaagggcgcgcgttcaaaggaatgttgaaactgacggcggaatataaaaacatcttcggmgatgcctgccgttcggaaacggcgttggagttgggcgcactcaatcaggcgttgcaggagatttcaaaaacatccgg

SEQ ID NO: 39865 - protein, 214 aa, Neisseria meningitidis
  misc_feature (86)..(86): Xaa can be any naturally occurring amino acid
  misc_feature (166)..(166): Xaa can be any naturally occurring amino acid
  misc_feature (185)..(185): Xaa can be any naturally occurring amino acid
MMMHASVQSRFAPILYVLIFFAGFLTAQIWFNQKAYTEELPPLLSALSAVALVWLAWAFVSARSKAKAEKFYREKMIQNESIHPVXHASLQHLEHKPQILALLVKNHGKGMAEQVRFKAEVLPDDEDARTIAAELAKMDMFALGTDAVASGETYGRVFADIFELSXALEGRAFKGMLKLTAEYKXHLRRCLPFGNGVGVGRTQSGVAGDFKNIR

SEQ ID NO: 39866 - DNA, 650 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggctaaggcggaaaagttctaccgcgaaaaaatgatacagaacgaaagcatacaccccgtcctgcacgcttctttgcaacacttggaacacaagccgcaaatgctcgccctgctggtcaaaaaccacggcaaagggatggcggaacaggtcaggttcaaggcggaagtgctgcccgacgacgaagacgcgcgcacgattgccgccgagttggcaaaaatggatatgtttgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcgctcaatcaggcgttgcaggagatttcaaaaacatcggaaaagtccaa

SEQ ID NO: 39867 - protein, 217 aa, Neisseria meningitidis
  misc_feature (185)..(185): Xaa can be any naturally occurring amino acid
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALEGRAFKGMLKLTAEYKXHLRRCLPFGNGVGVGRAQSGVAGDFKNIGKVQ

SEQ ID NO: 39868 - DNA, 507 bp, Neisseria gonorrhoeae
atgatgatgcacgcttctgtccaaagtcgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggtgcgttcaaaggctaaggcagaaaagttctaccgcgaaaaaatgatacagaacgaaagcatacaccccgtcctgcacgcttctttgcaacacttggaacacaagccgcaaatgctcgccctgctggtcaaaaaccacggcaaaggcatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatgggcgcgtgttcgccgatattttcgagttgtcggcggctttggaa

SEQ ID NO: 39869 - protein, 169 aa, Neisseria gonorrhoeae
MMMHASVQSRFAPILYVLIFFAGFLTAQIWFNQKAYTEELPPLLSALSAVALVWLAWAFVSVRSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALE

SEQ ID NO: 39870 - DNA, 666 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggccaaggcggaaaagttctaccgcgaaaaaatgatacagaacgaaagcatacaccccgtcctgcacgcctctttgcaacacttggaacacaagccgcaaatactcgccctgctggtcaaaaaccacggcaaagggatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcactcaatcaggcgttgcaggagatttcaaaaacatcggaaaagtccaaacggatattttattga

SEQ ID NO: 39871 - protein, 221 aa, Neisseria meningitidis
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQILALLVKNHGKGMAEQVRFKAEVLPDDEDARTIAAELAKMDMFALGTDAVASGETYGRVFADIFELSAALEGRAFKGMLKLTAEYKNIFGDACRSETALELGALNQALQEISKTSEKSKRIFY

SEQ ID NO: 39872 - DNA, 666 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggctaaggcggaaaagttctaccgcgaaaaaatgatacagaacgaaagcatacaccccgtcctgcacgcttctttgcaacacttggaacacaagccgcaaatgctcgccctgctggtcaaaaaccacggcaaagggatggcggaacaggtcaggttcaaggcggaagtgctgcccgacgacgaagacgcgcgcacgattgccgccgagttggcaaaaatggatatgtttgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcgctcaatcaggcgttgcaggagatttcaaaaacatcggaaaagtccaaacggatattttattga

SEQ ID NO: 39873 - protein, 221 aa, Neisseria meningitidis
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALEGRAFKGMLKLTAEYKNIFGDACRSETALELGALNQALQEISKTSEKSKRIFY

SEQ ID NO: 39874 - DNA, 582 bp, Neisseria gonorrhoeae
atgggtgcgggtgtagtattcgttgtctttcagccgttcttcagcctgtttcgagcgttgttcgagggcggagtcggtatagtcgagggagcgcacgatgccgctgaatgcgacttcttgtccgaggaatttacccgtatccggatcggtgatgtttttattgattcggtaggtcagataacggcccggttctttcaggcctttggtgtaaaccctggcgcctttggtgtacagcagcctgccttccgggcccgagagcaggcgcggcgcggcagcggtttctttgcgggaaacgatttgcgggtgctgcataaagacgcggtagaagttgacatcgatggcgggaataccgtatccggacacttccttatccggactgattttgacgacggggatgccgtctgtctgttccaagccgaggcgcggttcgccgccaacgtagcgcaacaccaatacctggcccggataaatcaggtcgggattgtggatttgatcccggttcgcgccccacagggggggaccattgccacgggctgtacaggtatttgcccgaaataccccacagggtgtcgccctgtttga

SEQ ID NO: 39875 - protein, 193 aa, Neisseria gonorrhoeae
MGAGVVFVVFQPFFSLFRALFEGGVGIVEGAHDAAECDFLSEEFTRIRIGDVFIDSVGQITARFFQAFGVNPGAFGVQQPAFRAREQARRGSGFFAGNDLRVLHKDAVEVDIDGGNTVSGHFLIRTDFDDGDAVCLFQAEARFAANVAQHQYLARINQVGIVDLIPVRAPQGGTIATGCTGICPKYPTGCRPV

SEQ ID NO: 39876 - DNA, 513 bp, Neisseria meningitidis
atgggtgcgggtatggtattcgttgtctttcggccgttctccagcctgtttcgagcgttgttcgaggacagagtcggtatagtcgagggagcgcacgatgccgctgaatgcgacttcctgcccgaggaatttacccgtatccggatcggtgatgtttttattgattcggtaggtcaggtagcggcccggctctttcaggcctttggtgtaaaccctggtgcctttggtgtacagcagcctgccttccgggcccgagwrcasgcgcggygcggcagcggtttctttgcgggaaacgatttgcggatgccgcataaagatgcggtagaagttgacatcgatggcgggaataccgtatccggacacttccttatccggactcattttgacgacggggatgccgtctgtctgttccaagccgaggcgcggttcgccgtcaacgtggcgcaacaccaatacctggtccggataaatcaggtcgggattgtggatttgatcccggttcgcgtyccacag

SEQ ID NO: 39877 - protein, 171 aa, Neisseria meningitidis
  misc_feature (86)..(87): Xaa can be any naturally occurring amino acid
  misc_feature (90)..(90): Xaa can be any naturally occurring amino acid
MGAGMVFVVFRPFSSLFRALFEDRVGIVEGAHDAAECDFLPEEFTRIRIGDVFIDSVGQVAARLFQAFGVNPGAFGVQQPAFRARXXARXGSGFFAGNDLRMPHKDAVEVDIDGGNTVSGHFLIRTHFDDGDAVCLFQAEARFAVNVAQHQYLVRINQVGIVDLIPVRVPQ

SEQ ID NO: 39878 - DNA, 581 bp, Neisseria meningitidis
atgggtgcgggtatggtattcgttgtctttcggccgttctccagcctgtttcgagcgttgttcgaggacagagtcggtatagtcgagggagcgcacgatgccgctgaatgcgacttcctgcccgaggaatttacccgtatccggatcggtgatgtttttattgattcggtaggtcaggtagcggcccggctctttcaggcctttggtgtaaaccctggtgcctttggtgtacagcagcctgccttccgggcccgagagcaggcgcggcgcggcagcggtttctttgcgggaaacgatttgcgggtgccgcataaagatgcggtagaagttgacatcgatggcgggaataccgtatccggacacttccttatccggactcattttgacgacggggatgccgtctgtctgttccaagccgaggcgcggttcgccgtcaacgtggcgcaacaccaatacctggtccagataaatcaggtcgggattgtggatttgatcccggttcgcgtcccacaggcggccccattgccacgggctgtacaggtatttgcccgaaatgccccacagggtgtcgccctgtttga

SEQ ID NO: 39879 - protein, 193 aa, Neisseria meningitidis
  misc_feature (174)..(174): Xaa can be any naturally occurring amino acid
MGAGMVFVVFRPFSSLFRALFEDRVGIVEGAHDAAECDFLPEEFTRIRIGDVFIDSVGQVAARLFQAFGVNPGAFGVQQPAFRAREQARRGSGFFAGNDLRVPHKDAVEVDIDGGNTVSGHFLIRTHFDDGDAVCLFQAEARFAVNVAQHQYLVQINQVGIVDLIPVRVPQAAXIATGCTGICPKCPTGCRPV

SEQ ID NO: 39880 - DNA, 714 bp, Neisseria gonorrhoeae
atggagcttgggcatatcgtattccttgtgctttgcgcgcgttcagacggcctttttactttccagacattccgccagcccgcgttcgcgcaagatacagctcgggcattcgcggcagccgccgacgatacccttgtagcaggtgtgggtctgttcgcggatgtagtccaacacgcccatttcgtccgccaacgcccacgtttgcgccttggtcaggtacatcagcggcgtgtggatttgaaaatcgtagtccatcgccagattaagggtaacgttcatggatttgacgaacacgccgcggcagtcgggatagcccgaaaaatcggtttcgcacacgcccgcgatgatgtgccggataccctgccctttggcaaaaatggcggcgtaaagcaggaaaagcgcgttacgcccgtccacaaaggtattgggaacgccgttgtcggcggtttcgatggcggcggtttcgatggcggcggtttcgtccatcagggcgttgtgcgtaatctgccgcatcaggctcaaatcgagtacggtttgactgacacccaaatcctgcgcgatccactctgcgcgttccagctcgacggcatggcgttgcccgtatcggaaggtgatggcttggacgttttcgcgcccgtaggtttggattgcctgaatcaggcaggtggtcgaatcctgaccgcccgagaagatgaccaaggctttttggtttga

SEQ ID NO: 39881 - protein, 237 aa, Neisseria gonorrhoeae
MELGHIVFLVLCARSDGLFTFQTFRQPAFAQDTARAFAAAADDTLVAGVGLFADVVQHAHFVRQRPRLRLGQVHQRRVDLKIVVHRQIKGNVHGFDEHAAAVGIARKIGFAHARDDVPDTLPFGKNGGVKQEKRVTPVHKGIGNAVVGGFDGGGFDGGGFVHQGVVRNLPHQAQIEYGLTDTQILRDPLCAFQLDGMALPVSEGDGLDVFAPVGLDCLNQAGGRILTAREDDQGFLV

SEQ ID NO: 39882 - DNA, 699 bp, Neisseria meningitidis
atggagcttgggcatatcgtattccttatggtttgcgcgtgttcagacggcctttttactttccagatattccgccagcccgcgttcgcgcaagatacagctcgggcattcgcggcagccgccgacgatgccgttatagcaggtgtgggtttgctcgcggatatagtccagcacgcccatttcgtccgccaacgcccacgtttgcgccttggtcagatacatcagcggcgtgtggatttgaaaatcatagtccatcgccaaattaagggtaacgttcatcgatttgacaaacacgtcgcggcagtcgggatagccggagaagtcggtttcgcacacgcccgcgatgatgtgccgtatcccctgccctttggcgtaaatcgcggcatagagcaggaaaagcgcgttgcggccgtctacaaaggtattcggaacgccgttttcggcagtttcgatggcggcggtgtcgtccatcagggcattgtgcgtaatctgccgcatcaggctcaagtcgagtacggtttgtttgacgcccaaatcctgcgcaatccagcgggcacgttccagctcgacggcatggcgttgcccgtattggaaagtaatggcttggacgttttcgcgcccgtaggtttggattgcctgaatcaggcaggtggtcgaatcctgaccgcccgaaaagatgaccaaggcttgttggtttga

SEQ ID NO: 39883 - protein, 232 aa, Neisseria meningitidis
MELGHIVFLMVCACSDGLFTFQIFRQPAFAQDTARAFAAAADDAVIAGVGLLADIVQHAHFVRQRPRLRLGQIHQRRVDLKIIVHRQIKGNVHRFDKHVAAVGIAGEVGFAHARDDVPYPLPFGVNRGIEQEKRVAAVYKGIRNAVFGSFDGGGVVHQGIVRNLPHQAQVEYGLFDAQILRNPAGTFQLDGMALPVLESNGLDVFAPVGLDCLNQAGGRILTARKDDQGLLV

SEQ ID NO: 39884 - DNA, 699 bp, Neisseria meningitidis
atggagcttgggcatatcgtattccttatggtttgcgcgtgttcagacggcctttttactttccagatattccgccagcccgcgttcgcgcaagatacagctcgggcattcgcggcagccgccgacgatgccgttatagcaggtgtgggtttgctcgcggatatagtccagcgcgcccatttcgtccgccaacgcccaagtttgcgccttggtcagatacatcagcggcgtgtggatttgaaaatcatagtccatcgccagattaagggtaacgttcatggatttgacaaacacgtcacggcagtcgggatagccggagaagtcggtttcgcacacgcccgcgatgatgtgccgtatcccctgccctttggcgtaaatcgcggcatagagcaggaaaagcgcgttgcggccgtctacaaaggtattcggaacgccgttttcggcagtttcgatggcggcggtgtcgtccatcagggcattgtgcgtaatctgccgcatcaggctcaagtcgagtacggtttgtttgacgcccaaatcctgcgcaatccagcgggcacgttccagctcgacggcatggcgttgcccgtattggaaagtaatggcttggacgttttcgcgcccgtaggtttggattgcctgaatcaggcaggtggtcgaatcctgaccgcccgaaaagatgaccaaggctttttggtttga

SEQ ID NO: 39885 - protein, 232 aa, Neisseria meningitidis
MELGHIVFLMVCACSDGLFTFQIFRQPAFAQDTARAFAAAADDAVIAGVGLLADIVQRAHFVRQRPSLRLGQIHQRRVDLKIIVHRQIKGNVHGFDKHVTAVGIAGEVGFAHARDDVPYPLPFGVNRGIEQEKRVAAVYKGIRNAVFGSFDGGGVVHQGIVRNLPHQAQVEYGLFDAQILRNPAGTFQLDGMALPVLESNGLDVFAPVGLDCLNQAGGRILTARKDDQGFLV

SEQ ID NO: 39886 - DNA, 549 bp, Neisseria gonorrhoeae
atggcacgtttaaccgtacacaccctcgaaaccgcccccgaagccgccaaaccgcgcgtagaggccgtacccaaaaacaacggctttatccccaacctcatcggcgtattggcaaacgcccccgaagctttggcgttttaccaagaagtcggcaagctcaacgccgccaacagcctgaccgccggcgaagtcgaagtgatccggatcatcgccgtccgcaccaaccaatgcagcttctgcgtggcagggcacaccaaactcgcaaccctgaaaaaactcctgtccgagcaatccctcaatgccgcccgcgctttggcggcaggtaaatctgacgatgccaaactcggcgcgcttgccgccttcacccaagccgtaatggcgaaaaaaggcgcagtatccgacgacgaactcaacgccttcctcgaagcgggctacaaccggcagcaggcagtcgaagtcgtaatgggcgtagccttggcaactttgtgcaactacgccaacaacctcgcccaaaccgaaatcaaccccaaattgcaggcatacgcctaa

SEQ ID NO: 39887 - protein, 182 aa, Neisseria gonorrhoeae
MARLTVHTLETAPEAAKPRVEAVPKNNGFIPNLIGVLANAPEALAFYQEVGKLNAANSLTAGEVEVIRIIAVRTNQCSFCVAGHTKLATLKKLLSEQSLNAARALAAGKSDDAKLGALAAFTQAVMAKKGAVSDDELNAFLEAGYNRQQAVEVVMGVALATLCNYANNLAQTEINPKLQAYA

SEQ ID NO: 39888 - DNA, 233 bp, Neisseria meningitidis
gcagcaggcgaatttgacgatgccaaactcggcgcgctcgccgccttcacccaagccgtaatggcgaaaaaaggcgcggtatccgacgaggaactcaaagcatttttcgatgcgggctacaaccagcagcaggcagtcgaagtcgtgatgggcgtasyctggcaaccctgtgcaactacgtcaacaacctcggacaaaccgaaatcaaccccgaattgcaggcttacgcctga

SEQ ID NO: 39889 - protein, 77 aa, Neisseria meningitidis
  misc_feature (52)..(52): Xaa can be any naturally occurring amino acid
  misc_feature (77)..(77): Xaa can be any naturally occurring amino acid
AAGEFDDAKLGALAAFTAVMAKKGAVSDEELKAFFDAGYNQQQAVEVVMGVXLATLCNYVNNLGQTEINPELQAYAX

SEQ ID NO: 39890 - DNA, 549 bp, Neisseria meningitidis
atggcacgtttaaccgtacacaccctcgaaaccgcccccgaagccgccaaagcgcgcgtcgaggcggtacttcaaaacaacggctttatccccaaccttatcggcgtattatcaaacgcccccgaagccttggcgttttaccaagaagtcggcaagctcaacgccgccaacagcctgaccgccggcgaagtcgaagtaatccagattattgccgcccgcaccaaccaatgcggcttctgcgtggcagggcacaccaaactcgcaaccctgaaaaaactcctttccgaacaatccgtcaaagccgcgcgcgctttggcggcaggcgaatttgacgatgctaaactcggcgcgctcgccgcctttacccaagccgtaatggcaaaaaaaggcgcggtatccgacgaggaactcaaagcattttttgatgcgggctacaaccagcagcaggcagtcgaagtcgtgatgggcgtagccttggcaactttgtgcaactacgtcaacaacctcggacaaaccgaaatcaaccccgaattgcaggcttacgcctga

SEQ ID NO: 39891 - protein, 182 aa, Neisseria meningitidis
MARLTVHTLETAPEAAKARVEAVLQNNGFIPNLIGVLSNAPEALAFYQEVGKLNAANSLTAGEVEVIQIIAARTNQCGFCVAGHTKLATLKKLLSEQSVKAARALAAGEFDDAKLGALAAFTQAVMAKKGAVSDEELKAFFDAGYNQQQAVEVVMGVALATLCNYVNNLGQTEINPELQAYA

SEQ ID NO: 39892 - DNA, 687 bp, Neisseria gonorrhoeae
ttgactttaacccgaaaaacccttttcctcctcaccgccgcgttcggcacacactcccttcagacggcatccgccgacgcagtggtcaagccggaaaaactgcacgcctccgccaaccgcagctacaaagtcgccgaattcacgcaaaccggcaacgcctcgtggtacggcggcaggtttcacgggcgcaaaacttccggcggagaccgctacgatatgaacgcctttaccgccgcccacaaaaccctgcccatccccagccatgtgcgcgtaaccaacaccaaaaacggcaaaagcgtcatcgtccgcgtcaacgaccgcggccccttccacggcaaccgcatcatcgacgtatccaaagccgccgcgcaaaaattgggctttgtcagccaagggacggcacacgtcaaaatcgaacaaatcgtcccgggccaatccgcaccggttgccgaaaacaaagacatctttatcgacttgaaatctttcggtacggaacacgaagcacaagcctatctgaaccaagccgcccaaaatttcgccgcttcgtcatcaagcccgaacctctcggttgaaaaacgccgttacgaatacgttgtcaaaatgggcccgtttgcctcgcaggaacgcgccgccgaagccgaagcgcaggcacgcggtatggttcgggcggtactgacctccggttga

SEQ ID NO: 39893 - protein, 228 aa, Neisseria gonorrhoeae
LTLTRKTLFLLTAAFGTHSLQTASADAVVKPEKLHASANRSYKVAEFTQTGNASWYGGRFHGRKTSGGDRYDMNAFTAAHKTLPIPSHVRVTNTKNGKSVIVRVNDRGPFHGNRIIDVSKAAAQKLGFVSQGTAHVKIEQIVPGQSAPVAENKDIFIDLKSFGTEHEAQAYLNQAAQNFAASSSSPNLSVEKRRYEYVVKMGPFASQERAAEAEAQARGMVRAVLTSG

SEQ ID NO: 39894 - DNA, 720 bp, Neisseria meningitidis
ttgactttaacccgaaaaacccttttccttctcaccgccgcattcggcacacactcccttcagacggcatccgccgacgcagtggtcaaggcagaaaaactgcacgcctccgccaaccgcagctacaaagtcgccggaaaacgctacacgccgaaaaaccaagtcgccgaattcacgcaaaccggcaacgcctcgtggtacggcggcaggtttcacgggcgcaaaacttccggcggagaacgatacgatatgaacgcctttaccgccgcccacaaaaccctgcccatccccagctatgtgcgcgtaaccaataccaaaaacggcaaaagcgtcatcgtccgcgtcaacgaccgcggccccttccacggcaaccgcatcatcgacgtatccaaagccgccgcgcaaaaattgggctttgtcaaccaagggacggcacacgtcaaaatcgaacaaatcgtcccgggccaatccgcaccggttgccgaaaacaaagacatctttatcgacttgaaatctttcggtacggaacacgaagcacaagcctatctgaaccaagccgcccaaaacttcgccgtttcgtcatcgggtacgaacctctcggttgaaaaacgccgttacgaatacgtcgtcaaaatgggaccgtttacctcgcaggaacgcgccgccgaagccgaagctcaggcgcgcggtatggttcgggcggtattgaccgccggctga

SEQ ID NO: 39895 - protein, 239 aa, Neisseria meningitidis
LTLTRKTLFLLTAAFGTHSLQTASADAVVKAEKLHASANRSYKVAGKRYTPKNQVAEFTQTGNASWYGGRFHGRKTSGGERYDMNAFTAAHKTLPIPSYVRVTNTKNGKSVIVRVNDRGPFHGNRIIDVSKAAAQKLGFVNQGTAHVKIEQIVPGQSAPVAENKDIFIDLKSFGTEHEAQAYLNQAAQNFAVSSSGTNLSVEKRRYEYVVKMGPFTSQERAAEAEAQARGMVRAVLTAG

SEQ ID NO: 39896 - DNA, 720 bp, Neisseria meningitidis
ttgactttaacccgaaaaacccttttcctcctcaccgccgcattcggcatacattcctttcagacggcatccgccgacgcagtggtcagggcagaaaaactgcacgcctccgccaaccgcagctacaaagtcgccggaaaacgctacacgccgaaaaaccaagtcgccgaattcacgcaaaccggcaacgcctcgtggtacggcggcaggtttcacgggcgcaaaacttccggcggagaacgatacgatatgaacgcctttaccgccgcccacaaaaccctgcccatccccagctatgtgcgcgtaaccaataccaaaaacggcaaaagcgtcatcgtccgcgtcaacgaccgcggccccttccacggcaaccgcatcatcgacgtatccaaagccgccgcgcaaaaattgggctttgtcaaccaagggacggcgcacgtcaaaatcgaacaaatcgtcccgggccaatccgcaccggttgccgaaaacaaagacatcttcatcgacttgaaatctttcggtacggaacacgaagcacaagcctatctgaaccaagccgcccaaaacctggcttcatcggcatcaaacccgaacctctcggttgaaaaacgccgttacgaatacgtcgtcaaaatgggaccgtttgcctcgcaggaacgcgccgccgaggccgaagctcaggcgcgcggtatggttcgggcggtattaaccgccggttga

SEQ ID NO: 39897 - protein, 239 aa, Neisseria meningitidis
LTLTRKTLFLLTAAFGIHSFQTASADAVVRAEKLHASANRSYKVAGKRYTPKNQVAEFTQTGNASWYGGRFHGRKTSGGERYDMNAFTAAHKTLPIPSYVRVTNTKNGKSVIVRVNDRGPFHGNRIIDVSKAAAQKLGFVNQGTAHVKIEQIVPGQSAPVAENKDIFIDLKSFGTEHEAQAYLNQAAQNLASSASNPNLSVEKRRYEYVVKMGPFASQERAAEAEAQARGMVRAVLTAG

SEQ ID NO: 39898 - DNA, 371 bp, Neisseria meningitidis
atgtcggtgattttgccgccgacacgcgccaacgctgctttttcggcttgggcgcggctgatgattttgtcttgtttgttgtgttggtgtgcggcgtgtccgtggtcgtcatcgccgtgtccgtcgtggtgggcgagcgcgggggcggaaatgctcagcagtgcggttgcggcggaggtcaagagaaggtgtttgatgttcatatttttgcctttgtaaatcgtgggttggaaaatgtggatattaataaggtatcaaataaccgtcagccggcggtcaataccgcccgaaccataccgcgcgcctgagcttcggcttcggcggcgcgttcctgcgaggtaaacggtcccattttgacgacgtattcgtaa

SEQ ID NO: 39899 - protein, 123 aa, Neisseria meningitidis
  misc_feature (69)..(69): Xaa can be any naturally occurring amino acid
  misc_feature (103)..(103): Xaa can be any naturally occurring amino acid
MSVILPPTRANAAFSAWARLMILSCLLCWCAACPWSSSPCPSWWASAGAEMLSSAVAAEVKRRCLMFIXFAFVNRGLENVDINKVSNNRQPAVNTARTIPRAXASASAARSCEVNGPILTTYS

SEQ ID NO: 39900 - DNA, 361 bp, Neisseria meningitidis
atgtcggtgattttgccgccgacacgcgccaacgctgctttttcggcttgggcgcggctgatgattttgtcttgtttgctgtgttggtgtgcggcgtgtccgtggtcgtcatcgccgtgtccgtcgtggtgggcgagtgcgggggcggaaatgcccatcagtgcggttgcggcggcggtcaagagaaggcgtttgaagttcatttttgctcctgcgaagtatctggtggtgtttgaaggacgtaaaggcgggacatcaaccggcggttaataccgcccgaaccataccgcgcgcctgagcttcggcctcggcggcgcgttcctgcgaggcaaacggtcccattttgacgacgtattcgtaa

SEQ ID NO: 39901 - protein, 119 aa, Neisseria meningitidis
  misc_feature (76)..(77): Xaa can be any naturally occurring amino acid
MSVILPPTRANAAFSAWARLMILSCLLCWCAACPWSSSPCPSWWASAGAEMPISAVAAAVKRRRLKFIFAPAKYLXXCLKDVKAGHQPAVNTARTIPRAASASAARSCEANGPILTTYS

SEQ ID NO: 39902 - DNA, 347 bp, Neisseria gonorrhoeae
agttcagacggcatcgccgccgacaatgcccaaacagaaagcccatcatgaccgcatccatgtacatccttttggtcttggcactcatctttgccaacgcccccttcctcacgaccagactgttcggcgtggccgcgctcaagcgcaaacatttcggacaccacctgatcgagctggcggcaggtttcgcgctgaccgcctctcttgcctacatcctcgaatcccgtgcgggagcggtacacaatcagggttgggagttttacgccaccgtcgtctgcctgtacctcattttcgccttcccgtgtttcgtgcggcggtatttttggcacacgcgcaacagggaataa

SEQ ID NO: 39903 - protein, 116 aa, Neisseria gonorrhoeae
MQFRRHRRRQCPNRKPIMTASMYILLVLALIFANAPFLTTRLFGVAALKRKHFGHHLIELAAGFALTASLAYILESRAGAVHNQGWEFYATVVCLYLIFAFPCFVRRYFWHTRNRE

SEQ ID NO: 39904 - DNA, 363 bp, Neisseria meningitidis
atgccgttccgcaacgcgttcagacggcatcgccgccgacaacgcctaaacagaaagcccaccatgaccgcatccatgtacatccttttggtcttggcactcatctttgccaacgcccccttcctcacgaccagactgttcggcgtggccrcactcaagcgcaaacatttcggacaccacatgatcgagctggcggcaggtttcgcgctgaccgccgttcttgcctacatcctsgaatcccgtgcaggatcggtacacgatcagggttgggagttttatgccacagtcgtctgcctgtacctgatttttgcgtttccatgttttgtgtggcggtatttttggcacacgcgcaacagggaatag

SEQ ID NO: 39905 - protein, 120 aa, Neisseria meningitidis
  misc_feature (51)..(51): Xaa can be any naturally occurring amino acid
MPFRNAFRRHRRRQRLNRKPTMTASMYILLVLALIFANAPFLTTRLFGVAXLKRKHFGHHMIELAAGFALTAVLAYILESRAGSVHDQGWEFYATVVCLYLIFAFPCFVWRYFWHTRNRE

SEQ ID NO: 39906 - DNA, 363 bp, Neisseria meningitidis
atgccgttccgcaatgcgttcagacggcatcgccgccgacaatgcccaaacagaaagcccgccatgaccgcatccatgtacatccttttgctgcttgccttgatttttgccaacgcccccttcctcacgaccaagctgttcggcatcgtaccgctcaagcgcaaacatttcggacaccacctgatcgagctggcggcaggtttcgcgctgaccgccgttcttgcctacatcctcgaatcccgtgcgggagcggtacacgatcagggttgggagttttacgccaccgtcgtctgcctgtacctgatttttgcgtttccctgtttcgtgtggcggtatttttggcacacgcgcaacagggaatag

SEQ ID NO: 39907 - protein, 120 aa, Neisseria meningitidis
MPFRNAFRRHRRRQCPNRKPAMTASMYILLLLALIFANAPFLTTKLFGIVPLKRKHFGHHLIELAAGFALTAVLAYILESRAGAVHDQGWEFYATVVCLYLIFAFPCFVWRYFWHTRNRE

SEQ ID NO: 39908 - DNA, 384 bp, Neisseria gonorrhoeae
atgcaagtcgccttttttctcgccgtggtattcaaaaatatgggtttccacaatcgcatcggtcgggcaggcctcttcgcagaaaccgcagaagatgcacttggtcaggtcgatgtcgtaacgcttggtgcggcgggtgccgtcttcgcgttcttccgattcgatgttgatcgccattgccggacacaccgcctcgcacaatttacacgcgatgcagcgttcctctccgttcggaaaacggcgttgcgcgtgcagaccgcggaaacgcacggattgcggcgttttctcttcgggaaaataaattgtgtctttgcgggcaaaaaagtttttgagcgttacgcccatgcctttgaccagttcgccaagcagaaaggtttttactaa

SEQ ID NO: 39909 - protein, 127 aa, Neisseria gonorrhoeae
MQVAFFLAVVFKNMGFHNRIGRAGLFAETAEDALGQVDVVTLGAAGAVFAFFRFDVDRHCRTHRLAQFTRDAAFLSVRKTALRVQTAETHGLRRFLFGKINCVFAGKKVFERYAHAFDQFAKQKGFY

SEQ ID NO: 39910 - DNA, 384 bp, Neisseria meningitidis
gtgcaagtcgccttttttctcgccgtggtattcaaaaatatgggtttccacaatcgcatcagtcgggcatgcctcttcgcagaaaccgcagaagatgcacttggtcaggtcgatgtcgtaacgcttggtgcggcgcgtaccgtcttcacgttcttccgattcgatgttaatcgccattgccggacacactgcctcacacaacttacacgcgatacaccgctcttcgccgttcggataccgccgctgcgcgtgcagaccgcggaaacgcacggattgcggcgttttctcttcggggaaataaattgtgtctttgcgggcgaaaaagtttttgagcgttacgcccataccttttaccaattcgccaagcagaaaggtttttactaa

SEQ ID NO: 39911 - protein, 127 aa, Neisseria meningitidis
VQVAFFLAVVFKNMGFHNRISRACLFAETAEDALGQVDVVTLGAARTVFTFFRFDVNRHCRTHCLTQLTRDTPLFAVRIPPLRVQTAETHGLRRFLFGEINCVFAGEKVFERYAHTFYQFAKQKGFY

SEQ ID NO: 39912 - DNA, 384 bp, Neisseria meningitidis
gtgcaagtcgccttttttctcgccgtggtattcaaaaatatgggtttccacaatcgcatcggtcgggcaggcttcttcgcagaaaccgcagaagatgcacttggtcaggtcgatgtcgtaacgcttggtgcggcgcgtgccgtcttcgcgttcttccgattcgatgttgatcgccattgcggggcaaacggcttcacacaatttacacgcgatgcagcgttcctcgccgtttggataacggcgttgcgcgtgcagaccgcggaaacgcacggattgcggcgttttctcttcgggaaaataaatcgtgtctttgcgggcaaaaaagtttttgagcgttacgcccataccttttaccaattcgccaagcagaaaggtttttactaa

SEQ ID NO: 39913 - protein, 127 aa, Neisseria meningitidis
VQVAFFLAVVFKNMGFHNRIGRAGFFAETAEDALGQVDVVTLGAARAVFAFFRFDVDRHCGANGFTQFTRDAAFLAVWITALRVQTAETHGLRRFLFGKINRVFAGKKVFERYAHTFYQFAKQKGFY

SEQ ID NO: 39914 - DNA, 1014 bp, Neisseria gonorrhoeae
atgaaaaaaaatttacccgcactggcattggcaagtatgctgattttgtcgggctgcgaccgtttgggaataggcaacccgttttccggaaaggaaatttcctgcggaagcgaagagactaaagagattttggtcaaactggtccgcgacaatgtcgaaggtgaaaccgtcaaaacttttgacgacgacgcattcaaagaccaagcatttgccgatatcggcatatcgcatatccgcagaatggtcgaacgtttgggcataaccgtcgatgaagtccgaactaccgagaaaaccgacacgtccagcaaactcaaatgtgaagccgcgttaaaactggacgtgcccgacgatgttgtcgattatgccgtcgccgccaaccaatctataggcaacagccataagaaaacgcccgacttttttgaaccctactaccgcaaagaaggcgcgtattatgtcaaaactatttcttacagcgtccagccgacagacgacaaaagcaaaatctttgccgaactcagtcaggcacacgatatcatccatccgctcagcgagctggtgtctatggcactgattaaagagccgttggacaaagcgaaacaaaggaacgaaaaacttgaagcggcagaagccaccgcgcaggaagcgagggaggcagaagaagcggcggcgcaggaggcattgggtcgggagcaggaagccgcccgcgtatccgaatgggaagaacgctacaagctgtcgcgcagcgagttcgagcagttttggaaaggattgcctcaaactgtacagaataagctgcaagcctcgcagaaaacatggaaaagcggtatggacaagatctgtgccaacaatgcgaaagccgaaggtgaaacgccaaacggcataaaagtcagtgagttggcgtgtaaaacggcagaaaccgaagcacgcttggaagagctgcacaaccgtaaaaaagcccttatcgacgaaatggtcagggaagaggacaagaaagaactgccaaagcggctctga

SEQ ID NO: 39915 - protein, 337 aa, Neisseria gonorrhoeae
MKKNLPALALASMLILSGCDRLGIGNPFSGKEISCGSEETKEILVKLVRDNVEGETVKTFDDDAFKDQAFADIGISHIRRMVERLGITVDEVRTTEKTDTSSKLKCEAALKLDVPDDVVDYAVAANQSIGNSHKKTPDFFEPYYRKEGAYYVKTISYSVQPTDDKSKIFAELSQAHDIIHPLSELVSMALIKEPLDKAKQRNEKLEAAEATAQEAREAEEAAAQEALGREQEAARVSEWEERYKLSRSEFEQFWKGLPQTVQNKLQASQKTWKSGMDKICANNAKAEGETPNGIKVSELACKTAETEARLEELHNRKKALIDEMVREEDKKELPKRL

SEQ ID NO: 39916 - DNA, 422 bp, Neisseria meningitidis
  misc_feature (209)..(209): n is a, c, g, or t
atggcactgattaaagagccgttggacaaagtgaaacaaaggaacgaagaacttgaagcggcagaagaagcggcggcgcaggaggcattgggtcgggagcaggaagccgcccgcgtatccgaatgggaagaacgctacaagctgtcgcgcagcagttcgagcagttctggaaaggattgcctcaaaccgtacagaataagctgcaaccntcacagaaaacatggaaaagcgggatggataaaatctgtgccaacaatgcgaaagctgaaggtaaaacgccaaacggcataaaattcagcgaactggcatgcaaaacggcgaaaaccgaagcacgcttggaagagctgcacaaccgtaaaaaagcccttatcgacgaaatggycagggaagcggacamgaaagaactgtcaaagcggctstga

SEQ ID NO: 39917 - protein, 140 aa, Neisseria meningitidis
  misc_feature (51)..(51): Xaa can be any naturally occurring amino acid
  misc_feature (128)..(128): Xaa can be any naturally occurring amino acid
  misc_feature (133)..(133): Xaa can be any naturally occurring amino acid
MALIKEPLDKVKQRNEELEAAEEAAAQEALGREQEAARVSEWEERYKLSRXQFEQFWKGLPQTVQNKLQPSQKTWKSGMDKICANNAKAEGKTPNGIKFSELACKTAKTEARLEELHNRKKALIDEMXREADXKELSKRL

SEQ ID NO: 39918 - DNA, 423 bp, Neisseria meningitidis
atggcactgattaaagagccgttggacaaagcgaaacaaaggaacgaagaacttgaagcggcagaagaagcggcggcgcaggaggcattgggtcgggagcaggaagtcgaccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtgaaacgccaaacggcataaaattcagcgaactggcatgcaaaacggcggaaaccgaagcacgcttggaagagctgcacaaccgtaaaaaagcccttctcgacgaaatggccagggaagcggacaagaaagaactgccaaagcggctctga

SEQ ID NO: 39919 - protein, 140 aa, Neisseria meningitidis
MALIKEPLDKAKQRNEELEAAEEAAAQEALGREQEVDRVSEWEERYKLSRSEFEQFWKGLPQTVQNKLQASQKTWKSGMDKICANNAKAEGETPNGIKFSELACKTAETEARLEELHNRKKALLDEMAREADKKELPKRL

SEQ ID NO: 39920 - DNA, 477 bp, Neisseria meningitidis
gtgcaatcccgatatgatggtttgcataaatttaaacatatatgttccgcagctatggcactgattaaagagccgttggacaaagtgaaacaaaggaacgaagaacttgaagcggcagaagaagcggcggcgcaggaggcattgggtcgggagcaggaagccgcccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtaaaacgccaaacggcataaaattcagcgaactggcatgcaaaacggcgaaaaccgaagcacgcttggaagagctgcacaaccgtaaaaaagcccttatcgacgaaatggccagggaagcggacaagaaagaactgtcaaagcggctctga

SEQ ID NO: 39921 - protein, 158 aa, Neisseria meningitidis
VQSRYDGLHKFKHICSAAMALIKEPLDKVKQRNEELEAAEEAAAQEALGREQEAARVSEWEERYKLSRSEFEQFWKGLPQTVQNKLQASQKTWKSGMDKICANNAKAEGKTPNGIKFSELACKTAKTEARLEELHNRKKALIDEMAREADKKELSKRL

SEQ ID NO: 39922 - DNA, 477 bp, Neisseria meningitidis
gtgcaatcccgatatgatggtttgcataaatttaaacatatatgttccgcagctatggcactgattaaagagccgttggacaaagcgaaacaaaggaacgaagaacttgaagcggcagaagaagcggcggcgcaggaggcattgggtcgggagcaggaagtcgaccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtgaaacgccaaacggcataaaattcagcgaactggcatgcaaaacggcggaaaccgaagcacgcttggaagagctgcacaaccgtaaaaaagcccttctcgacgaaatggccagggaagcggacaagaaagaactgccaaagcggctctga

SEQ ID NO: 39923 - protein, 158 aa, Neisseria meningitidis
VQSRYDGLHKFKHICSAAMALIKEPLDKAKQRNEELEAAEEAAAQEALGREQEVDRVSEWEERYKLSRSEFEQFWKGLPQTVQNKLQASQKTWKSGMDKICANNAKAEGETPNGIKFSELACKTAETEARLEELHNRKKALLDEMAREADKKELPKRL

SEQ ID NO: 39924 - DNA, 366 bp, Neisseria gonorrhoeae
atggtttggcgtgtgaattgcgcggcaacggcggcgctgattttttcgtccagcccttggatttgggcggtggtgtgggtgtggtcgcggtcggctttttcctgcaaaccttgcgccagccttgacgcgtccagtgcgccggcgttggcggtttcgccgtgggactttatccggaacacggcttcgcccaaggtgtcggcggctttgatgcacagttttaaaaccagggctttggggcggttttctgcgccgcccgttgccattttgctgtccaatcgcggggttaaaaaaccgttgtcgtttaagtcgccgtccgtccaagtcgatacgagcgcgcttctttgcctttcattgcggtcttcgtaa

SEQ ID NO: 39925 - protein, 121 aa, Neisseria gonorrhoeae
MVWRVNCAATAALIFSSSPWIWAVVWVWSRSAFSCKPCASLDASSAPALAVSPWDFIRNTASPKVSAALMHSFKTRALGRFSAPPVAILLSNRGVKKPLSFKSPSVQVDTSALLCLSLRSS

SEQ ID NO: 39926 - DNA, 363 bp, Neisseria meningitidis
atggtttggcgtgtgaattgcgcggcaacggcggtgctgattttttcgtccagcccttggatttgggcggcggtgtgggtgtggtctcggtcggctttgtcttgcaaaccttgcgccacgtgcccgcgtccagcgcctgcgttgatggtttcgccgtgggactttatccaaaacacggcttcgcccaaggtgtcggcggctttgatgcacagttttaaaaccagggctttggggcggttttcgtcgccgcctgtcgccattttgctgtccgagcgcggggttaaaaagccgttgtcgtttaaattttcgtccgtccaagtcgatacgagcgcgcttctctgcctttcgttgcggtcttcgtaa

SEQ ID NO: 39927 - protein, 120 aa, Neisseria meningitidis
MVWRVNCAATAVLIFSSSPWIWAAVWVWSRSALSCKPCATCPRPAPALMVSPWDFIQNTASPKVSAALMHSFKTRALGRFSSPPVAILLSERGVKKPLSFKFSSVQVDTSALLCLSLRSS

SEQ ID NO: 39928 - DNA, 366 bp, Neisseria meningitidis
atggtttggcgtgtgaattgcgcggcaacggcggtgctgattttttcgtccagcccttggatttgggcggcggtgtgggtgtgggcgcggtctgctttgtcttggaggttttgcgccagcgtgcccgcgtccagcgcgccggcgttgacggtttcgccgtgggactttatccagaacacggcttcgcccaaggtgtcggcggctttgatgcacagttttaaaaccagggctttggggcggttttcgtcgccgcctgtcgccattttgctgtccgggcgcggggttaaaaagccgttgtcgtttaaattttcgtccgtccaagtcgatacgagcgcgcttctctgcctttcgttgtggtcttcgtaa

SEQ ID NO: 39929 - protein, 121 aa, Neisseria meningitidis
MVWRVNCAATAVLIFSSSPWIWAAVWVWARSALSWRFCASVPASSAPALTVSPWDFIQNTASPKVSAALMHSFKTRALGRFSSPPVAILLSGRGVKKPLSFKFSSVQVDTSALLCLSLWSS

SEQ ID NO: 39930 - DNA, 423 bp, Neisseria gonorrhoeae
atgaataaaaaccgcaaattactgcttgccgcactgctgctgactgcctttgccgccttcaagctcgttttgttgcaatggtggcaggcgcagcagccgcaagccgtggcggcgcaatgcgatttgaccgagggttgcacgctgccggacggaagccgtgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagcacgcatccgcctgcccgtctgtgtcgaaggcaggcgcgattttacggcggacattacaatcggcagccggacatttcagacggcatttaccgccgaataa

SEQ ID NO: 39931 - protein, 140 aa, Neisseria gonorrhoeae
MNKNRKLLLAALLLTAFAAFKLVLLQWWQAQQPQAVAAQCDLTEGCTLPDGSRVRAAAVSTKKPFDIYIEHAPAGTEQVSISFSMKNMDMGFNRYMFERQPSGTWQAARIRLPVCVEGRRDFTADITIGSRTFQTAFTAE

SEQ ID NO: 39932 - DNA, 422 bp, Neisseria meningitidis
atgaataaaaaccgtaaattactgcttgccgcactgctgctgattgcctttgccgccgtcaagctcgttttgttgcaatggtggcaggcgcacagccgcaagctgtggcggcgcaatgcgatttgaccgagggttgcacgctgccggacggaagccgcgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagtacgcatccgcctgcccatctgtgtcgaaggcaggcgcgattttacggcggacattacaatcggcagtcggacatttcagacggcatttaccgccgaataa

SEQ ID NO: 39933 - protein, 140 aa, Neisseria meningitidis
  misc_feature (31)..(31): Xaa can be any naturally occurring amino acid
MNKNRKLLLAALLLIAFAAVKLVLLQWWQAXQPQAVAAQCDLTEGCTLPDGSRVRAAAVSTKKPFDIYIEHAPAGTEQVSISFSMKNMDMGFNRYMFERQPSGTWQAVRIRLPICVEGRRDFTADITIGSRTFQTAFTAE

SEQ ID NO: 39934 - DNA, 423 bp, Neisseria meningitidis
atgaataaaaaccgtaaattactgcttgccgcactgctgctgattgcctttgccgccgtcaagctcgttttgttgcaatggtggcaggcgcagcagccgcaagctgtggcggcgcaatgcgatttgaccgagggttgcacgctgccggacggaagccgcgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagtacgcatccgcctgcccatctgtgtcgaaggcaggcgcgattttacggcggacattacaatcggcagccggacatttcagacggcatttaccgccgaataa

SEQ ID NO: 39935 - protein, 140 aa, Neisseria meningitidis
MNKNRKLLLAALLLIAFAAVKLVLLQWWQAQQPQAVAAQCDLTEGCTLPDGSRVRAAAVSTKKPFDIYIEHAPAGTEQVSISFSMKNMDMGFNRYMFERQPSGTWQAVRIRLPICVEGRRDFTADITIGSRTFQTAFTAE

SEQ ID NO: 39936 - DNA, 573 bp, Neisseria gonorrhoeae
atgttcagttcgcggatggcgaggatttgggcgacgggggtaacgttgtgtatggtcagtccgtgtccggcgttgacgaccaagcccaaatcgccggcgaaatgcgcgccgttttggatgcgctcgaactgcctgatttgttcggcgtggctttgtgcgtcggcatatgcgccggtgtgcagctcgacaacgggcgcgccgacatcacgggcggcttggatttgcctgtcgtcggcatcgataaacaaggacacgcgtatgcccgcgtcggtcaggattttggcgaattcggcgattttttcctgttgcgccaatacgtccaaaccgccttcggtcgtgatttcctgccgtttttcaggcacgatgcacacgtcttccggcatcactttaagcgcgttttcgagcatttcttccgtcaacgccatttcaaggttcaggcgcgtgcggatggcgtttttgacggcaaatacatccgcgtctttgatgtggcggcggtcttcgcgcaggtgcatggtaatcaggtctgcaccgtgcgtttcggcaaccagtgccgcctccacggggctgggataa

SEQ ID NO: 39937 - protein, 190 aa, Neisseria gonorrhoeae
MFSSRMARIWATGVTLCMVSPCPALTTKPKSPAKCAPFWMRSNCLICSAWLCASAYAPVCSSTTGAPTSRAAWICLSSASINKDTRMPASVRILANSAIFSCCANTSKPPSVVISCRFSGTMHTSSGITLSAFSSISSVNAISRFRRVRMAFLTANTSASLMWRRSSRRCMVIRSAPCVSATSAASTGLG

SEQ ID NO: 39938 - DNA, 573 bp, Neisseria meningitidis
awgttcagttcgcggatggcgaggatttgggcgatgggggtaacgttgtgtatggtcagtccgtgtccggcgttgacgaccaagcccaaatcgccggcgaaatgcgcgccgttttggatgcgctcgaactgcctgatttgttcggcgtggctgcgcgcgtcggcatacgcgcctgtgtgcagctcgacaacgggcgcgccgacatcacgggcggcttggatttgcctgtcgtcggcatcgataaacaaagacacgcgtatgcctgcgtcggtcaggattttggtgaacccggcgattttttcctgttgcgccaatacgtccaaaccgccttcggtcgtgatttcctgacgtttttcaggcacgatgcacacgtcttccggcatcactttcaaagcgttttccaacatttcttccgtcaacgccatttcaaggttcaggcgcgtgcggatggcgtttttgacggcaaacacgtccgcgtctttgatgtggcggcggtcttcgcgcaggtgcatggtaatcaaatccgcaccgtgcgtttcggcaaccagtgccgcctccacggggctgggataa

SEQ ID NO: 39939 - protein, 190 aa, Neisseria meningitidis
  misc_feature (1)..(1): Xaa can be any naturally occurring amino acid
  misc_feature (116)..(116): Xaa can be any naturally occurring amino acid
XFSSRMARIWAMGVTLCMVSPCPALTTKPKSPAKCAPFWMRSNCLICSAWLRASAYAPVCSSTTGAPTSRAAWICLSSASINKDTRMPASVRILVNPAIFSCCANTSKPPSVVISXRFSGTMHTSSGITFKAFSNISSVNAISRFRRVRMAFLTANTSASLMWRRSSRRCMVIKSAPCVSATSAASTGLG

SEQ ID NO: 39940 - DNA, 573 bp, Neisseria meningitidis
atgttcagttcgcggatggcgaggatttgggcgatgggggtaacgttgtgtatggtcagtccgtgtccggcgttgacgaccaagcccaaatcgctggcaaaatgcgcgccgttttggatgcgctcgaactgcctgatttgttcggcgtggctgcgcgcgtcggcatacgcgcctgtgtgcagctcgacaacgggcgcgccgacatcacgggcggcttggatttgcctgtcgtcggcatcgataaacaaggacacgcgtatgcccgcgtcggtcaggattttggtgaattcggcaattttgtcttgttgcgccaatacgtccaagccgccttcggtcgtgatttcctgacgtttttccggcacgatgcacacgtcttccggcatcactttaagcgcgttttcgagcatttcttccgtcaacgccatttcaaggttcaggcgcgtgcggatggcgtttttgacagcaaacacgtccgcgtctttgatgtggcggcggtcttcgcgcaggtgcatggtaatcaggtcggcaccgtgcgtttcggcaaccagtgccgcctccacggggctgggataa

SEQ ID NO: 39941 - protein, 189 aa, Neisseria meningitidis
MFSSRMARIWAMGVTLCMVSPCPALTTKPKSLAKCAPFWMRSNCLICSAWLRASAYAPVCSSTTGAPTSRAAWICLSSASINKDTRMPASVRILVNSAILSCCANTSKPPSVVISRFSGTMHTSSGITLSAFSSISSVNAISRFRRVRMAFLTANTSASLMWRRSSRRCMVIRSAPCVSATSAASTGLG

SEQ ID NO: 39942 - DNA, 1113 bp, Neisseria gonorrhoeae
atgactgcaaaggaagaactgttcgcatggctgcgccatatgaacaaaaacaaaggttccgacctgtttgtgacgacccatttcccgcccgctatgaagctggacggcaaaatcacccgcatcacggacgaaccgctgacggcggaaaaatgtatggaaatcgccttttcgattatgagtgcgaagcaggcggaagaattttcatcgaccaacgagtgcaatttcgccatcagcctgccggacaccagccgcttccgcgtcaatgcgatgatacagcgcggtgcgacggcgttggtattccgcgcgattaccagcaagattcccaagtttgaaagcctgaacctgccgccggccttgaaggatgttgcgctgaaaaaacgcgggctggttatttttgtcggcggcaccggctcgggcaaatcgacttcgctcgcctcgcttatcgactaccgcaatgaaaattcgttcggacacatcatcaccatcgaagatccgatcgagtttgtccacgaacacaaaaactgcatcattacccagcgcgaggtcggcgtggacacggaaaactggatggcggcgttgaaaaatacgctgcgtcaggcgccggatgtgatccttatcggcgaaatccgcgaccgtgaaacaatggactacgccatcgcctttgccgaaacggggcatttgtgtatggcgacgctgcacgccaacagcaccaatcaggcgctcgaccgcatcatcaacttcttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgaccaacacctttaccaattgtatgaaaaaggcgagatttccttgcaggatgccttgaaaaatgccgattccgcacatgatttgcgtttggcggtacagttgcgcagccgcagggcacaaagttccgaccccgatttggaactgctctga

SEQ ID NO: 39943 - protein, 370 aa, Neisseria gonorrhoeae
MTAKEELFAWLRHMNKNKGSDLFVTTHFPPAMKLDGKITRITDEPLTAEKCMEIAFSIMSAKQAEEFSSTNECNFAISLPDTSRFRVNAMIQRGATALVFRAITSKIPKFESLNLPPALKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGEISLQDALKNADSAHDLRLAVQLRSRRAQSSDPDLELL

SEQ ID NO: 39944 - DNA, 1113 bp, Neisseria meningitidis
  misc_feature (1103)..(1103): n is a, c, g, or t
atgaccgcaaaggaagaactgttcgcatggctgcgccatatgawccaaaacaaaggttccgacctgttcgtgacaacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggcgcgacggcgttggtattccgtacgattaccagcaagattcccaagtttgaaagcctgaacctgccgccagtcttgaaggatgtcgcgctgaaaaaacgcgggctggttatttttgtcggcggcaccggctcgggtaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcgcctgatgtcatccttatcggcgaaatccgtgaccgcgaaacaatggactacgccattgcctttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgatcaacacctttaccaattgtatgaaaaaggcgatatttccctgcaagaagcattgaaaaatgccgattccgcacacgatttgcgtttggcggtacagttgcgcagccgccgcgcgcaaagttycagccccgatttggnactgctctga

SEQ ID NO: 39945 - protein, 370 aa, Neisseria meningitidis
  misc_feature (15)..(15): Xaa can be any naturally occurring amino acid
  misc_feature (363)..(363): Xaa can be any naturally occurring amino acid
  misc_feature (368)..(368): Xaa can be any naturally occurring amino acid
MTAKEELFAWLRHMXQNKGSDLFVTTHFPPAMKLDGKITRITDEPLTAEKCMEIAFSIMSAKQAEEFSSTNECNFAISLPDTSRFRVNAMIQRGATALVFRTITSKIPKFESLNLPPVLKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGDISLQEALKNADSAHDLRLAVQLRSRRAQSXSPDLXLL

SEQ ID NO: 39946 - DNA, 1113 bp, Neisseria meningitidis
atgaccgcaaaggaagaactgttcgcatggctgcgccatatgaacaaaaacaaaggttccgacctgttcgtgacgacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagtctgccggacaccagccgcttccgcgtcaatgcgatgatacagcgcggtgcgacggcgttggtattccgtgcgattaccagcaagattcccaagtttgaaagcctgaacctgccgccggtcttgaaggatgtcgcgctgaaaaaacgcgggctggttatttttgtcggcggcaccggctcgggcaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcaccggatgtgattctgatcggcgaaatccgcgaccgcgaaacaatggactacgccattgcttttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcatttatttcgcaacgcctcgttccgcgagacggcggcaagggcagggtggcggcagtcgaggtgctgctcaattcgcccctgatttcggagttgattcacaacggcaatatccatgaaatcaaagaagtgatgaaaaaatccactaccctgggtatgcagactttcgaccaacacctttaccaattgtatgaaaaaggcgagatttccttgcaggatgccttgaaaaatgccgattccgcacacgatttgcgtttggcggtacagttgcgcagccgccaggcgcaaagttccggtcccgatttggaactgctctga

SEQ ID NO: 39947 - protein, 370 aa, Neisseria meningitidis
MTAKEELFAWLRHMNKNKGSDLFVTTHFPPAMKLDGKITRITDEPLTAEKCMEIAFSIMSAKQAEEFSSTNECNFAISLPDTSRFRVNAMIQRGATALVFRAITSKIPKFESLNLPPVLKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGEISLQDALKNADSAHDLRLAVQLRSRQAQSSGPDLELL

SEQ ID NO: 39948 - DNA, 516 bp, Neisseria gonorrhoeae
  misc_feature (368)..(368): n is a, c, g, or t
atgagtcttcaggcggtatttatataccccccaagccgtaccgcacaatacaacgaaaatcaggaaaacggcggtaaagctcataaacagggacaaagcggcaaacacaccgaccgccgtcaggatataggcgtattcgaggccggaactccattcaccgttttcctgccgtttcttgtcgcttttgaaataaaggatgatgccggcaagcagcgcggcagccgcgcccgacattggcattgtgttcattgttgttccttaacggttaaaaacccgcccggccgtgcaaccgttttaaggcgggaaattgcaaaatttgtttgcgggcgcgtgccgctgaaatcaaggcggtttgagaagtgtttccnacgcgcccgccctatgtgccgaaatattatttgtcgctcacctgcaaaatcgccaagaacgcgctttgcggaatttccacgttgcccacttgtttcatacggcgtttgcctgctttttgtttttcaagcagttttttcttacgcgtaa

SEQ ID NO: 39949 - protein, 171 aa, Neisseria gonorrhoeae
  misc_feature (123)..(123): Xaa can be any naturally occurring amino acid
MSLQAVFIYPPSRTAQYNENQENGGKAHKQGQSGKHTDRRQDIGVFEAGTPFTVFLPFLVAFEIKDDAGKQRGSRARHWHCVHCCSLTVKNPPGRATVLRREIAKFVCGRVPLKSRRFEKCFXRARPMCRNIICRSPAKSPRTRFAEFPRCPLVSYGVCLLFVFQAVFSYA

SEQ ID NO: 39950 - DNA, 513 bp, Neisseria meningitidis
atgagtcttcaggcggtatttatatacccmccaagccgtaccgcacaatacaacgaaaatcaggaaaacggcggtaaagctcayaaacagggacaaagcggcaaacacgccgaccgctgtcaggatataggcgtattcaaggccggaactccattccccgttttcctgccgcttcttgtcgcttttgaaataaaggatgatgccggcaagcagcgcggcagccgcgcccgacattagcattgtgttcattgttgttccttaatgcttaaaaacccgcctgtccgtgcaaccgttttaaggcggcaaattgcaaaatttgtttgcgggcgcgtgcccctgaaatcagggcggtttgaggggtgttcccgacgcgccgccctgtgtgccggagttatttgtcgctcacctgcaaaatcgccaagaacgcgctttgcggaatttccacattgcccacttgtttcatacggcgtttacctgccttttgtktwtcaagcagttttttcttacgcgtaa

SEQ ID NO: 39951 - protein, 169 aa, Neisseria meningitidis
  misc_feature (162)..(162): Xaa can be any naturally occurring amino acid
MSLQAVFIYPPSRTAQYNENQENGGKAHKQGQSGKHADRCQDIGVFKAGTPFPVFLPLLVAFEIKDDAGKQRGSRARHHCVHCCSLMLKNPPVRATVLRRQIAKFVCGRVPLKSGRFEGCSRRAALCAGVICRSPAKSPRTRFAEFPHCPLVSYGVYLPFVXQAVFSYA

SEQ ID NO: 39952 - DNA, 513 bp, Neisseria meningitidis
atgagtcttcaggcggtatttgtataccccccaagccgtaccgcacaatacaacgaaaatcaggaaaacggcggtaaagctcataaacagggacaaagcggcaaacacgccgaccgccgtcaggatataggcgtattccagaccggaactccattcaccgttttcctgccgctttttgtcgcttttgaaataaaggatgatgccggcaagcagcgcggcagccgcgcccgacattagcataatgttcattgttgttccttaacggttaaaaacccgcccgtccgtgcaaccgtttttaagaggcggtaaatcacaaagtttgttggcggacgtgctctcttacaatcagggcggtttaaggggcatgatgcactgccccgtgtgccggatattatttgtcgctcacctgcaaaattgccaagaacgcgctttgcgggatttccacattgcccacttgtttcatacggcgtttgcctgctttttgtttttcaagcagttttttcttacgcgtaa

SEQ ID NO: 39953 - protein, 168 aa, Neisseria meningitidis
MSLQAVFVYPPSRTAQYNENQENGGKAHKQGQSGKHADRRQDIGVFQTGTPFTVFLPLFVAFEIKDDAGKQRGSRARHHNVHCCSLTVKNPPVRATVFKRRITKFVGGRALLQSGRFKGHDALPRVPDIICRSPAKLPRTRFAGFPHCPLVSYGVCLLFVFQAVFSYA

SEQ ID NO: 39954 - DNA, 492 bp, Neisseria gonorrhoeae
atggcggggccgatttttgtcgtcatcgccagcgtcgctatgttttttgtcgcgcagcagcacgcgacagatttggttacggacgattattataaggatggcaagcatatcgacatccagcttcatcgggatgaagaagccgtcagacggcatatcggggtgcaggtcctcatttctcccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaacccttccgccggccaaccactggtatgtgcgcgtggaggacgcggcaggcgtgtggcgcgtcgagaacaaatggattaccagccagggcaatgcggtcgatttgaccccgatggacaaacttttcaataatgcaggaagcaaataa

SEQ ID NO: 39955 - protein, 163 aa, Neisseria gonorrhoeae
MAGPIFVVIASVAMFFVAQQHATDLVTDDYYKDGKHIDIQLHRDEEAVRRHIGVQVLISPDMNAAKVFVGGEFDGKQPLNLLLMHPTRKADDQTVALKPVGSAQNGRAEYEAVFKTLPPANHWYVRVEDAAGVWRVENKWITSQGNAVDLTPMDKLFNNAGSK

SEQ ID NO: 39956 - DNA, 492 bp, Neisseria meningitidis
atggcggggccgatttttgtcgtcatcgccagcgtcgctatgttttttgtcgcgcagcagcacgcgacagatttggttacggacgattattataaagacggcaaacatatcgacatccagcttcatcgggatgaagaagccgtcagacggcatatcggggtgcaggttctcatttcccccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaaccctttcgccgaccaaccactggtatgtgcgcgtggaggacgcggcaggcgtgtggcgcgtcgagaacaaatggattaccagccaaggcaatgcggtcgatttgaccccgatggacaagcttttcaataatactgaaagcaaataa

SEQ ID NO: 39957 - protein, 163 aa, Neisseria meningitidis
MAGPIFVVIASVAMFFVAQQHATDLVTDDYYKDGKHIDIQLHRDEEAVRRHIGVQVLISPDMNAAKVFVGGEFDGKQPLNLLLMHPTRKADDQTVALKPVGSAQNGRAEYEAVFKTLSPTNHWYVRVEDAAGVWRVENKWITSQGNAVDLTPMDKLFNNTESK

SEQ ID NO: 39958 - DNA, 492 bp, Neisseria meningitidis
atggcggggccgatttttgtcgtcatcgccagcgtcgctatgttttttgtcgcgcagcagcacgcgacagatttggttacggacgattattataaagacggcaagcatatcgacatccagcttcatcgggatgaagaagccgtcagacggcatatcggggtgcaggttctcatttcccccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaaccctttcgccgaccaaccactggtatgtgcgcgtggaggacgcggcaggcgtgtggcgcgtcgagaacaaatggattaccagccaaggcaatgcggtcgatttgaccccgatggacaaacttttcaataatactgaaagcaaataa

SEQ ID NO: 39959 - protein, 163 aa, Neisseria meningitidis; identical to SEQ ID NO: 39957

SEQ ID NO: 39960 - DNA, 837 bp, Neisseria gonorrhoeae
atgattttgccgccatccatgacgatgatgcggtcggcggattcgacggtggtcaggcggtgggcgacgatgatgccggtgcggttttccatcaggcgttcgagcgcttgttggacgaggcgttcggattcgttgtccaatgcgctggtggcttcgtccaataataatatcggcgcgtctttcaaaatggcgcgggcgatggcgacgcgttgccgctgtccgccggataagttgctgccgttcgatccgatgggctggtgcagtccgagcggggatgcgtcgatcaggctttgcaggttggcggcttggagggcggacaggacttcggcttcgcccgcgtcgggacggctgtatcggacgttttcaaacagggtgtcgtcaaacaggaatacgtcttgggagacgagggcgaattgggcgcgcaggcagtcgagtttgatgtcggcgatgtcgataccgtctatgcagatgttgccggcagacggttcgacaaagcggggcagaaggttgacgacggtggatttgccgctgccggaacgtccgaccagggcgacgcgttcgccttgtctgatgtcgaggttgaagttgtcgagggctttgatgccgtctgaacggtattcgacatcgacgttgcggaagctgatgcgcccttcgacacgctgcggcgcgagcgtgcctttgtcctgttcgggcggggtgtcgagaaatgcacatacgccgtcggcggcgaggaacatcgtctgcatagggatgctgatgttggcaaggcttttgatgggggcgtacatttgcagcatcgcgacgatgaatgccataaattcgccgatggtggtgtag

SEQ ID NO: 39961 - protein, 278 aa, Neisseria gonorrhoeae
MILPPSMTMMRSADSTVVRRWATMMPVRFSIRRSSACWTRRSDSLSNALVASSNNNIGASFKMARAMATRCRCPPDKLLPFDPMGWCSPSGDASIRLCRLAAWRADRTSASPASGRLYRTFSNRVSSNRNTSWETRANWARRQSSLMSAMSIPSMQMLPADGSTKRGRRLTTVDLPLPERPTRATRSPCLMSRLKLSRALMPSERYSTSTLRKLMRPSTRCGASVPLSCSGGVSRNAHTPSAARNIVCIGMLMLARLLMGAYICSIATMNAINSPMVV

SEQ ID NO: 39962 - DNA, 837 bp, Neisseria meningitidis
atgattttgccgtcgtccatcacgatgatgcggtcggccccttcgatggtggtcaggcggtgggcgacgatgatgccggtgcggttttccatcaggcgttcgagcgcctgttggacgaggcgttcggattcgttgtctaatgcgctggtggcttcgtccaataataatatcggcgcgtctttcaaaatggcgcgggcaatggcgacgcgttgccgctgtccgccggataagttgctgccgttcgatccgatgggctggtgcagtccgagcggggagctgtcaatcaggctttgcaggttggcggtttggagggcgaacaggacttcggcttcgcccgcgtcgggacggctgtatcggacgttttcaaacagggtgtcgtcaaacaggaatacgtcttgggagacgagggcgaattgggcgcgcaggcagtcgagtttgatgtcggcgatgtcgataccgtctatgcagatgttgccggcagacggttcgacaaagcggggcagcaggttgacgacggtggatttgccgctgccggaacgtccgaccagggcgacgcgttcgccttgtctgatgtcgaggttgaagttgtcgagggctttgatgccgtctgaacggtattcgacatcgacgttgcggaagctgatgcgcccttcgacacgctgcggtgcgagcgtgcccttgtcctgttcgggcggggtgtcgagaaatgcacatacaccgtcggcggcgaggaacatcgtctgcatagggatgctgatgttggcaaggcttttgatgggggcgtacatttgcagcatcgcgacgatgaatgccataaattcgccgatggtggtgtag

SEQ ID NO: 39963 - protein, 278 aa, Neisseria meningitidis
MILPSSITMMRSAPSMVVRRWATMMPVRFSIRRSSACWTRRSDSLSNALVASSNNNIGASFKMARAMATRCRCPPDKLLPFDPMGWCSPSGELSIRLCRLAVWRANRTSASPASGRLYRTFSNRVSSNRNTSWETRANWARRQSSLMSAMSIPSMQMLPADGSTKRGSRLTTVDLPLPERPTRATRSPCLMSRLKLSRALMPSERYSTSTLRKLMRPSTRCGASVPLSCSGGVSRNAHTPSAARNIVCIGMLMLARLLMGAYICSIATMNAINSPMVV

SEQ ID NO: 39964 - DNA, 837 bp, Neisseria meningitidis
atgattttgccgtcgtccattacgatgatgcggtcggccccttcgatggtggtcaggcggtgggcgacgatgatgccggtgcggttttccatcaggcgttcgagcgcctgttggacgaggcgttcggattcgttgtccaatgcgctggtggcttcgtccaataataatatcggcgcgtctttcaaaatggcgcgggcaatggcaacgcgttgccgctgtccgccggataagttgctgccgttcgatccgatgggctggtgcagtccgagcggtgatgcgtcgatcaggctttgcaggttagcggcttggagggcggataggacttcggcttcgcccgcgtcgggacggctatatcggacgttttcaaacagggtgtcgtcaaacaggaatacgtcttgggagacgagggcaaattgggcgcgcaggcagtcgagtttgatgtcggcgatgtcgataccgtctatgcagatgttgccggcagacggttcgacaaagcggggcagcaggttgacgacggtggatttgccgctgccggaacgtccgaccagggcgacgcgttcgccttgtctgatgtcgaggttgaagccgtcgagggctttgatgccgtccgaacggtattcgacatcgacgttgcggaagctgatgcgcccttcgacacgctgcggtgcgagcgtgcctttgtcctgttcgggcggggtgtcgagaaatgcacatacgccgtcggcggcgaggaacatcgtctgcatagggatgctaatgttggcaaggcttttgatgggggcgtacatttgcagcatcgcgacgatgaatgccataaattcgccgatggtggtgtag

SEQ ID NO: 39965 - protein, 278 aa, Neisseria meningitidis
MILPSSITMMRSAPSMVVRRWATMMPVRFSIRRSSACWTRRSDSLSNALVASSNNNIGASFKMARAMATRCRCPPDKLLPFDPMGWCSPSGDASIRLCRLAAWRADRTSASPASGRLYRTFSNRVSSNRNTSWETRANWARRQSSLMSAMSIPSMQMLPADGSTKRGSRLTTVDLPLPERPTRATRSPCLMSRLKPSRALMPSERYSTSTLRKLMRPSTRCGASVPLSCSGGVSRNAHTPSAARNIVCIGMLMLARLLMGAYICSIATMNAINSPMVV

SEQ ID NO: 39966 - DNA, 669 bp, Neisseria gonorrhoeae
atggtacacgtcgccgtagcttacggtattgccgtccggcgtttttgcccaaacgaggtcatagacgttttccacgccttgcaggtacatcgccaagcgttcgatgccgtaggtaatttcgccgagtacgggcgtgcaatcgataccgccgacttgttggaaataggtaaactgggttacttccatgccgttgagccagacttcccagcccaaaccccacgcaccgagggtggggttttcccagtcgtcttcgacaaagcggatgtcgtggactttgggatcgatgcccaattcgcgcagggagtcgagatagaggtcttggatattggcgggggcgggtttgagggcgacttggaattggtaatagtgttgcaggcggttggggttgtcgccgtagcggccgtctttggggcggcggctgggttggacgtaggcggcaaaccaaggctcggggccgagcgcgcgcaggcaggtggcgggatgggatgtgccggcaccgacttccatgtcgaagggttggatgacggtgcagcctttgtctgcccagaaggtttgcagtttgaagatgatttgttggaaggtaagcatggcttattgttcgataaaataaaggttttattttactgtttccatagccgcttgaatagatttatctcgaagacagcctga

SEQ ID NO: 39967 - protein, 222 aa, Neisseria gonorrhoeae
MVHVAVAYGIAVRRFCPNEVIDVFHALQVHRQAFDAVGNFAEYGRAIDTADLLEIGKLGYFHAVEPDFPAQTPRTEGGVFPVVFDKADVVDFGIDAQFAQGVEIEVLDIGGGGFEGDLELVIVLQAVGVVAVAAVFGAAAGLDVGGKPRLGAERAQAGGGMGCAGTDFHVEGLDDGAAFVCPEGLQFEDDLLEGKHGLLFDKIKVLFYCFHSRLNRFISKTA

SEQ ID NO: 39968 - DNA, 759 bp, Neisseria meningitidis
atgccccgctttgaggacaagctcgtaggcaggcagggcgagggcggcgttttcttcggcaagcaggcgtttggcttgcgcttcgtagtcgttgaactggcgcagcagccagtcggcatcgctgtattcgaagttgtaggtggattgctcgacttcgttttggtggtacacgtcgccgtaggtgacggtgttgccgtcgagcgtttttgcccaaacgaggtcgtagacgttttctacaccttgcaagtacatcgccaagcgttcgatgccgtaggtgatttcgccgagtacgggcgtgcagtcgatgccgccgacttgttggaaataggtaaactgggttacttccatgccgttgagccagacttcccagcccaaaccccacgcgccgagggtggggttttcccagtcgtcttcgacaaagcggatgtcgtggactttgggatcgatgcccaattcgcgcagagagtcgagatagaggtcttggatattggcgggagcgggcttgagggcgacttggaattggtaatagtgttgcaggcggttggggttgtcgccgtagcggccgtctttggggcggcggctgggttggacgtaggcggcaaaccaaggctcggggccgagtgcgcgcaggcaggtggcgggatgggatgtgccggcaccgacttccatgtcgaagggttggatgacggtgcagcctttgtctgcccagaatgtttgcagtttgaagatgatttgttggaaggtaagcatggcttatga

SEQ ID NO: 39969 - protein, 252 aa, Neisseria meningitidis
MPRFEDKLVGRQGEGGVFFGKQAFGLRFVVVELAQQPVGIAVFEVVGGLLDFVLVVHVAVGDGVAVERFCPNEVVDVFYTLQVHRQAFDAVGDFAEYGRAVDAADLLEIGKLGYFHAVEPDFPAQTPRAEGGVFPVVFDKADVVDFGIDAQFAQRVEIEVLDIGGSGLEGDLELVIVLQAVGVVAVAAVFGAAAGLDVGGKPRLGAECAQAGGGMGCAGTDFHVEGLDDGAAFVCPECLQFEDDLLEGKHGL

SEQ ID NO: 39970 - DNA, 759 bp, Neisseria meningitidis
atgccccgctttgaggacaagctcgtaggcaggcagggcgagggcggcgttttcttcggcaagcaggcgtttggcttgcgcttcgtagtcgttgaactggcgcagcagccaatcggcatcgctgtattcgaagttgtaggtggattgttcgacttcgttttggtggtacacgtcgccgtaagttactgtattaccgtccagcgtttttgcccaaacgaggtcatagacgttttccacgccttgcaggtacatcgccaagcgttcgatgccgtaggtgatttcgccgagtacgggggtgcagtcgatgccgccgacttgttggaaataggtgaactgggttacttccataccgttgagccagacttcccagcccaaaccccacgcgccgagggtggggttttcccagtcgtcttcgacaaagcggatgtcgtgcactttggggtcgatgcccaattcgcgcagggagtcgagatagaggtcttggatattggcgggagcgggcttgagggcgacttggaattggtaatagtgttgcaggcggttggggttgtcgccgtagcgaccgtctttggggcggcggctgggttggacgtaggcggcaaaccaaggctcggggccgagtgcgcgcagacaggtggcgggatgggatgtgccggcaccgacttccatgtcgaagggttggatgacggtgcagcctttgtctgcccagaatgtttgcagtttgaagatgatttgttggaaggtaagcatggcttatga

SEQ ID NO: 39971 - protein, 252 aa, Neisseria meningitidis
MPRFEDKLVGRQGEGGVFFGKQAFGLRFVVVELAQQPIGIAVFEVVGGLFDFVLVVHVAVSYCITVQRFCPNEVIDVFHALQVHRQAFDAVGDFAEYGGAVDAADLLEIGELGYFHTVEPDFPAQTPRAEGGVFPVVFDKADVVHFGVDAQFAQGVEIEVLDIGGSGLEGDLELVIVLQAVGVVAVATVFGAAAGLDVGGKPRLGAECAQTGGGMGCAGTDFHVEGLDDGAAFVCPECLQFEDDLLEGKHGL

SEQ ID NO: 39972 - DNA, 512 bp, Neisseria gonorrhoeae
ttgcgtgcaatcacgcccggtgcgattttttcgacaggggcggtcaaagttgtattaatcggacctttgccgtcgataggccgacccaatgcatcgacgacgcgtccgaccaattcgcgtccgaccggcacttctaaaatacggccggtacaggtaaccgtgtcgccttctttaatatgttcgtactcgcccaacactacggcaccgacggagtcgcgctccaggttcatcgccaagcctaaagtgttacccgggaattcgagcatctcaccttgcattgcatctgacaaaccatggatgcgaacgataccgtcagttaccgaaatcaccgtaccacgggtactcacttcggcatttacagacagattttcgatcttggctttaatcagatcgctaatttcagcaggattaagctgcatgaaaactctcctaattcgtcatagtcgtgtacaaagcactcagtttgccttgtacagacaaatccaaaacctgatcacccacttcaactttta

SEQ ID NO: 39973 - protein, 170 aa, Neisseria gonorrhoeae
LRAITPGAIFSTGAVKVVLIGPLPSIGRPNASTTRPTNSRPTGTSKIRPVQVTVSPSLICSYSPNTTAPTESRSRFIAKPKVLPGNSSISPCIASDKPWMRTIPSVTEITVPRVLTSAFTDRFSILALIRSLISAGLSCMKTLLIRHSRVQSTQFALYRQIQNLITHFNF

SEQ ID NO: 39974 - DNA, 660 bp, Neisseria meningitidis
ttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatgtgttcgtactcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaattaccgtaccacaggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcaccaactcgccgacctgtttgtcggtcaacggataggcactgtaaatgacggcagatttgatatggttgaatga

SEQ ID NO: 39975 - protein, 219 aa, Neisseria meningitidis
LRAITPGAIFSIGAVKVVLIGPLPSIGRPNASTTRPTSSRPTGTSKIRPVQVTVSPSLMCSYSPNTTAPTESRSRFIAKPKVLPGNSSISPCIASDKPWMRTIPSVTEITVPQVRTSAFTDRFSILALIKSLISAGLSCMKTLLIRHSRVQGTQFALYRQIQNLITHFNFYAANQLRFDFDRDFQLAVETLIQHLHQLADLFVGQRIGTVNDGRFDMVE

SEQ ID NO: 39976 - DNA, 660 bp, Neisseria meningitidis
ttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatatgttcgtgctcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaatcaccgtaccacgggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcgccaactcgccgacctgtttgtcggtcaacggataggcactgtaaatgacggcagatttgatatggttgaatga

SEQ ID NO: 39977 - protein, 219 aa, Neisseria meningitidis
LRAITPGAIFSIGAVKVVLIGPLPSIGRPNASTTRPTSSRPTGTSKIRPVQVTVSPSLICSCSPNTTAPTESRSRFIAKPKVLPGNSSISPCIASDKPWMRTIPSVTEITVPRVRTSAFTDRFSILALIKSLISAGLSCMKTLLIRHSRVQGTQFALYRQIQNLITHFNFYAANQLRFDFDRDFQLAVETLIQHLRQLADLFVGQRIGTVNDGRFDMVE

SEQ ID NO: 39978 - DNA, 459 bp, Neisseria gonorrhoeae; identical to SEQ ID NO: 38729

SEQ ID NO: 39979 - protein, 152 aa, Neisseria gonorrhoeae; identical to SEQ ID NO: 38730

SEQ ID NO: 39980 - DNA, 459 bp, Neisseria meningitidis; identical to SEQ ID NO: 38727

SEQ ID NO: 39981 - protein, 152 aa, Neisseria meningitidis; identical to SEQ ID NO: 38728

SEQ ID NO: 39982 - DNA, 459 bp, Neisseria meningitidis; identical to SEQ ID NO: 38731
  misc_feature (6)..(6): n is a, c, g, or t
  misc_feature (8)..(8): n is a, c, g, or t
  misc_feature (38)..(39): n is a, c, g, or t
  misc_feature (96)..(96): n is a, c, g, or t
  misc_feature (102)..(102): n is a, c, g, or t
  misc_feature (341)..(341): n is a, c, g, or t
  misc_feature (390)..(390): n is a, c, g, or t
  misc_feature (410)..(410): n is a, c, g, or t

SEQ ID NO: 39983 - protein, 152 aa, Neisseria meningitidis; identical to SEQ ID NO: 38732
  misc_feature (3)..(3): Xaa can be any naturally occurring amino acid
  misc_feature (13)..(13): Xaa can be any naturally occurring amino acid
  misc_feature (114)..(114): Xaa can be any naturally occurring amino acid
  misc_feature (137)..(137): Xaa can be any naturally occurring amino acid

SEQ ID NO: 39984 - DNA, 927 bp, Neisseria gonorrhoeae
atgaaacacctcaaacttacccttattgccgcattgctggccaccgccgcaactgccgcaccccttccggttgtaaccagtttcagcattttaggcgacgtagccaaacaaatcggcggtgagcgcgtagccgtacaaagcctcgtcggagccaaccaagatactcatgcctatcacatgaccagtggcgacattaaaaaaatccgcagtgcaaaactcgtcctgctcaacggcttgggacttgaagccgccgacatccaacgcgccgtcaaacagagcaaagtatcctatgccgaagcgaccaaaggcatccaacccctcaaagccgaagaagaaggcggacaccatcacgaccaccatcacgaccacgatcatgaccacgaaggacaccaccacgaccacggcgaatatgacccccacgtctggaacgaccctgttcttatgtccgactatgcccaaaacgtcgctgaaaccctgataaaggccgatcccgaaggcaaagtttattatcaacaacgcttgggcaactaccaaatgcagcttaaaaaactgcacagcgacgcacaagccgcatttaatgccgtccctgccgccaaacgcaaagtcctgaccgggcacgacgcattttcctacatgggcaaccgctacaacatcagcttcatcgccccgcaaggcgtgagcagcgaagccgagccgtccgccaaacaagtcgccgccatcatccggcaaatcaaacgcgaaggcatcaaagccgtatttaccgaaaatatcaaagacacccgcatggttgaccgcatcgccaaagaaaccggcgtcaacgtcagcggcaaactgtattccgacgcactcggcaacgcgcccgcagacacctacatcggcatgtaccgccacaacgtcgaagccttgaccaacgcgatgaagcaataa

SEQ ID NO: 39985 - protein, 308 aa, Neisseria gonorrhoeae
MKHLKLTLIAALLATAATAAPLPVVTSFSILGDVAKQIGGERVAVQSLVGANQDTHAYHMTSGDIKKIRSAKLVLLNGLGLEAADIQRAVKQSKVSYAEATKGIQPLKAEEEGGHHHDHHHDHDHDHEGHHHDHGEYDPHVWNDPVLMSDYAQNVAETLIKADPEGKVYYQQRLGNYQMQLKKLHSDAQAAFNAVPAAKRKVLTGHDAFSYMGNRYNISFIAPQGVSSEAEPSAKQVAAIIRQIKREGIKAVFTENIKDTRMVDRIAKETGVNVSGKLYSDALGNAPADTYIGMYRHNVEALTNAMKQ

SEQ ID NO: 39986 - DNA, 915 bp, Neisseria meningitidis
atgaaacacctcaaactcacccttattgccgcattgctgaccgcctccgcaactgccgcccccctgccggttgtaaccagcttcagcattttaggcgacgtagccaaacaaatcggcggagagcgcgtatccatacaaagtttggtcggagccaaccaagatacgcacgcctatcatatgaccagtggcgacattaaaaaaatccgcagtgcaaaactcgtcctgctcaacggcttaggacttgaagctgccgatgtgcaacgcgccgtcaaacaaagcaaagtatcctataccgaagcgaccaaaggcatccaacccctcaaagccgaagaagaaggcggacaccatcacgaccacgatcatgaccacgaaggacaccaccatgaccacggcgaatatgacccgcacgtctggaacgaccccgtccttatgtccgcctatgcccaaaacgttgccaaagccctgataaaggccgatcccgaaggcaaagtttattatcaacaacgcttgggcaactaccaaatgcagctcaaaaaactgcacagcgacgcacaagccgcatttaatgccgtccctgctgccaaacgcaaagtcctgaccgggcacgatgccttttcctatatgggcaaacgttaccatatcgaattcatcgccccgcaaggcgtgagcagcgaagccgagccttcggccaaacaagtcgccgccatcatccgacaaatcaaacgcgaaggcatcaaagccgtctttaccgaaaacatcaaggacacccgtatggttgaccgtatcgccaaagaaaccggtgtcaacgtcagcggcaaactgtattccgacgcactcggcaacgcgcccgcagacacctacatcggaatgtaccgccacaacatcaaagccttgaccaacgcgatgaagcaataa

SEQ ID NO: 39987 - protein, 304 aa, Neisseria meningitidis
MKHLKLTLIAALLTASATAAPLPVVTSFSILGDVAKQIGGERVSIQSLVGANQDTHAYHMTSGDIKKIRSAKLVLLNGLGLEAADVQRAVKQSKVSYTEATKGIQPLKAEEEGGHHHDHDHDHEGHHHDHGEYDPHVWNDPVLMSAYAQNVAKALIKADPEGKVYYQQRLGNYQMQLKKLHSDAQAAFNAVPAAKRKVLTGHDAFSYMGKRYHIEFIAPQGVSSEAEPSAKQVAAIIRQIKREGIKAVFTENIKDTRMVDRIAKETGVNVSGKLYSDALGNAPADTYIGMYRHNIKALTNAMKQ

SEQ ID NO: 39988 - DNA, 927 bp, Neisseria meningitidis
atgaaacaccccaaactcacccttatcgccgcattgctgaccactgccgcaactgccgcccccctgccggttgtaaccagcttcagcattttaggcgacgtagccaaacaaatcggcggagagcgcgtatccatacaaagtttggtcggagccaaccaagatacgcacgcctatcatatgaccagcggcgacattaaaaaaatccgcagtgcaaaactcgtcctgattaacggcttaggacttgaagctgccgacatccaacgtgccgtcaaacagagcaaagtatcctatgccgaagcgaccaaaggcatccaacccctcaaagccgaagaagaaggcggacaccatcacgaccacgatcatgaccacgaccatgaccacgaaggacaccaccacgaccacggcgaatatgacccccacgtctggaacgaccccgtccttatgtccgcctatgcccaaaacgtcgccgaagccctgataaaggccgaccccgaaggcaaagtttattatcaacaacgcttgggcaactaccaaatgcagctcaaaaaactgcacagtgacgcacaagccgcatttaatgccgtccctgccgccaaacgcaaagtcctgaccgggcacgatgccttttcctatatgggcaaacgttaccatatcgaattcatcgccccacaaggtgtgagcagcgaagccgagccttcagccaaacaagtcgccgccatcatccgacaaatcaaacgcgaaggcatcaaagccgtatttaccgaaaatatcaaagacacccgcatggttgaccgcatcgccaaagaaaccggtgtcaacgtcagcggcaaactgtattccgacgcactcggcaacgcacccgcagacacctacatcggcatgtaccgccacaacatcaaagccttaaccaacgcgatgaagcaataa

SEQ ID NO: 39989 - protein, 308 aa, Neisseria meningitidis
MKHPKLTLIAALLTTAATAAPLPVVTSFSILGDVAKQIGGERVSIQSLVGANQDTHAYHMTSGDIKKIRSAKLVLINGLGLEAADIQRAVKQSKVSYAEATKGIQPLKAEEEGGHHHDHDHDHDHDHEGHHHDHGEYDPHVWNDPVLMSAYAQNVAEALIKADPEGKVYYQQRLGNYQMQLKKLHSDAQAAFNAVPAAKRKVLTGHDAFSYMGKRYHIEFIAPQGVSSEAEPSAKQVAAIIRQIKREGIKAVFTENIKDTRMVDRIAKETGVNVSGKLYSDALGNAPADTYIGMYRHNIKALTNAMKQ

SEQ ID NO: 39990 - DNA, 828 bp, Neisseria gonorrhoeae
atgcactacgccctcgcatccgtcttctgcctgtccctcagcgccgcacccgtcggcgtattcctcgtcatgcgccgtatgagcctgataggcgacgcattgagccacgccgtcctgcccggtgccgccgtcggctacatgtttgccggcttgagcctgcccgctatgggtgtgggcgggtttgccgccggtatgctgatggcgctgcttgccggactcgtcagccgctttaccaccctgaaagaagatgccaactttgccgccttttacctgagcagcctcgccatcggcgtaatcctcatcagcaaaaacggcagcagcgtcgatttactccacctccttttcggatctgtgcttgccgtcgatattcccgcactgcaactcatcgccgccgtctccggcctcacgctcattacccttgccgtcatctaccgccccctggtgctagaaagcatagacccccttttcctcaagtccgtcaacggcaaaggcgggctttggcacgtcattttcctcatcctcgtcgttatgaacctcgtatccggcttccaagctctcggcatcctgatgtcggtcggaattatgatgctgcccgccattaccgcccgtttatgggcaagaaatatggggacgctcattctgttgtccgtcctcatcgcccttttttgcggtttgatcgggctgctcatttcctaccacatcgaaatcccttccggccccgccatcatcctctgttgcagcgtcctttatcttttttccgtcatactcggcaaagaaggcggcatcttgcccaaatggttcaaaaaccaccgccaccacaccacctga

SEQ ID NO: 39991 - protein, 275 aa, Neisseria gonorrhoeae
MHYALASVFCLSLSAAPVGVFLVMRRMSLIGDALSHAVLPGAAVGYMFAGLSLPAMGVGGFAAGMLMALLAGLVSRFTTLKEDANFAAFYLSSLAIGVILISKNGSSVDLLHLLFGSVLAVDIPALQLIAAVSGLTLITLAVIYRPLVLESIDPLFLKSVNGKGGLWHVIFLILVVMNLVSGFQALGILMSVGIMMLPAITARLWARNMGTLILLSVLIALFCGLIGLLISYHIEIPSGPAIILCCSVLYLFSVILGKEGGILPKWFKNHRHHTT

SEQ ID NO: 39992 - DNA, 792 bp, Neisseria meningitidis
atgcgctacgccctcgcatccgtcttctgcctgtccctcagtgccgcacccgtcggcgtattcctcgtcatgcgccgtatgagcctgataggcgacgcattgagccacgccgtcctgcccggtgccgccgtcggctacatgtttgccggcttgagcctgcccgccatgggtttgggcggcgtagccgcaggcatgctgatggcactgcttgccggactcgtcagccgcttcaccaccctgaaagaagatgccaactttgccgccttttatctcagcagcctcgccatcggcgtagtcctcgtcagcaaaaacgggagcagcgtcgatttgctccacctccttttcggctctgtacttgccgtcgatattcctgccctgcagctcatcgccgccgtctccagcctcacgctcattacccttgccgtcatctaccgcccgctcgtactcgaaagcatcgaccccctgtttctcaaatccgtcggcggcaaaggcgggctttggcacgtcctctttctcgtcctggtcgtcatgaacctcgtatccggctttcaagccctcggcacactcatgtccgtcggactcatgatgctgccagccattaccgcccgcctgtgggcgaagcatatgggcgcactcatcctcctatccgttctgacagccctgctgtgcggcttgagcggactgctcatttcctaccacatcgaaattccttccggtcccgccatcatcctctgttgcagcgtcctttatctcttttccgtcatactcggcaaagaaggcggcattctgacc

SEQ ID NO: 39993 - protein, 264 aa, Neisseria meningitidis
MRYALASVFCLSLSAAPVGVFLVMRRMSLIGDALSHAVLPGAAVGYMFAGLSLPAMGLGGVAAGMLMALLAGLVSRFTTLKEDANFAAFYLSSLAIGVVLVSKNGSSVDLLHLLFGSVLAVDIPALQLIAAVSSLTLITLAVIYRPLVLESIDPLFLKSVGGKGGLWHVLFLVLVVMNLVSGFQALGTLMSVGLMMLPAITARLWAKHMGALILLSVLTALLCGLSGLLISYHIEIPSGPAIILCCSVLYLFSVILGKEGGILT

SEQ ID NO: 39994 - DNA, 828 bp, Neisseria meningitidis
atgcgctacgccctcgcatccgtcttctgcctgtccctcagtgccgcacccgtcggcgtattcctcgtcatgcgccgtatgagcctgataggcgacgcattgagccacgccgtcctgcccggtgccgccgtcggctacatgtttgccggcttaagcctgcccgccatgggtttgggcggcgtagccgcaggtatgctgatggcactgcttgccggactcgtcagccgcttcaccaccctgaaagaagatgccaactttgccgccttttatctcagcagcctcgccatcggtgtagtcctcgtcagcaaaaacggcagcagcgtcgatttgctccacctccttttcggctccgtacttgccgtcgatattcctgccctgcaactcatcgccgccgtatccaccctcacactgcttacccttgccgtcatctaccgcccgctcgtactcgaaagcatcgaccccctgtttctcaaatctgtcggcggcaaaggcgggctttggcacgtcctctttctcgtcctggtcgtcatgaacctcgtatccggctttcaagccctcggcacactcatgtccgtcggacttatgatgctgccagccattaccgcccgcctatgggcgaagcacatgggcgcactcatcctcctatccgttctgacagccctgctgtgcggcttgagcggactgctcatttcctaccacatcgaaattccttccggtcccgccatcatcctctgttgcagcgtcctttatctcttttccgtcatactcggcaaagaaggcggcattctgaccaaatggctcaaaaaccaccgccaccacaccacctga

SEQ ID NO: 39995 - protein, 275 aa, Neisseria meningitidis
MRYALASVFCLSLSAAPVGVFLVMRRMSLIGDALSHAVLPGAAVGYMFAGLSLPAMGLGGVAAGMLMALLAGLVSRFTTLKEDANFAAFYLSSLAIGVVLVSKNGSSVDLLHLLFGSVLAVDIPALQLIAAVSTLTLLTLAVIYRPLVLESIDPLFLKSVGGKGGLWHVLFLVLVVMNLVSGFQALGTLMSVGLMMLPAITARLWAKHMGALILLSVLTALLCGLSGLLISYHIEIPSGPAIILCCSVLYLFSVILGKEGGILTKWLKNHRHHTT

SEQ ID NO: 39996 - DNA, 654 bp, Neisseria gonorrhoeae
atgggattgggtatggaaatcggcaagctgattgtggctcttttggtgctgatcaatccgtttagcgcgttgtcgctttaccttgacctgaccaacggacacagcacgaaggagcgcaggaaggtcgcgcggacggccgccgtcgccgtgtttgccgtgattgcggtatttgcgctgatcggcggtgcgctattgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaagcgcgccccgcccgcaatgcaggggcgattgccgtcgtgcccatcgccataccgatcaccatcggtccgggcggtatttcgactgtgattatttatgcttcggcagccaaaacgtacagcgatatcgcgctgattatcgcggccggtttggtggtcagtgcgatttgttatgccattttaatcgttgccgggaaggtcagccgcctgctgggcgcgacggggctgacgattttaaaccgcattatgggtatgatgctggcggcggtatcggtggagattattgtgtcgggactgaaaacgatattcccgcaactggcaggttga

SEQ ID NO: 39997 - protein, 217 aa, Neisseria gonorrhoeae
MGLGMEIGKLIVALLVLINPFSALSLYLDLTNGHSTKERRKVARTAAVAVFAVIAVFALIGGALLKVLGISVGSFQVGGGILVLLIAISMMNGNDNPAKQNLGAQPETGQARPARNAGAIAVVPIAIPITIGPGGISTVIIYASAAKTYSDIALIIAAGLVVSAICYAILIVAGKVSRLLGATGLTILNRIMGMMLAAVSVEIIVSGLKTIFPQLAG

SEQ ID NO: 39998 - DNA, 654 bp, Neisseria meningitidis
atgggattgggcatggaaatcggcaagctgattgtggcttttttggtgctgattaatccgtttagcgcgttgtcgctttaccttgacctgaccaacgggcacagcacgaaggagcgcaggaaggtcgcgcggacggccgccgttgccgtgtttgccgtgattgcggtatttgcgctgatcggcggtacgctgctgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaggcgcgccccgcccgcaatgccggagcgattgccgtcgtgcccatcgccataccgatcaccatcggcccgggcggtatttcgaccgtgattatttacgcttcggcggctaaaacatacggcgacatcgcgttgattatcgcggccggtttggtggtcagtgcgatttgttatgccattttaatcgttgccgggaaggtcagccgcctgctgggcgcgacggggctgacgattttaaaccgcattatgggtatgatgctggcggcggtatcggtggagattattgtgtcgggactgaaaacgatattcccgcaactggcaggttga

SEQ ID NO: 39999 - protein, 217 aa, Neisseria meningitidis
MGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQARPARNAGAIAVVPIAIPITIGPGGISTVIIYASAAKTYGDIALIIAAGLVVSAICYAILIVAGKVSRLLGATGLTILNRIMGMMLAAVSVEIIVSGLKTIFPQLAG

SEQ ID NO: 40000 - DNA, 654 bp, Neisseria meningitidis
atgggattgggcatggaaatcggcaagctgattgtggcttttttggtgctgattaatccgtttagcgcgttgtcgctttaccttgacctgaccaacgggcacagcacgaaggagcgcaggaaggtcgcgcggacggccgccgttgccgtgtttgccgtgattgcggtatttgcgctgatcggcggtacgctgctgaaggttttgggcatcagcgtcggttcgtttcaggtcggcggcggaattttggtgttgctgattgccatttcgatgatgaacggcaacgacaatcccgccaagcagaatctcggcgcgcagccggaaacggggcaggtgcgccccgcccgcaatgccggagcgattgccgtcgtgcccatcgccataccgatcaccatcggcccgggcggtatttcgaccgtgattatttacgcttcggcggctaaaacatacggcgacatcgcgttgattatcgcggccggtttggtggtcagtgcgatttgttatgccattttaatcgttgccgggaaggtcagccgcctgctgggtgcgacggggctgacgattttaaaccgtatcatgggtatgatgctggcggcggtatcggtggagattattgtgtcgggactgaaaatgatattcccgcaactggcaggttga

SEQ ID NO: 40001 - protein, 217 aa, Neisseria meningitidis
MGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQVRPARNAGAIAVVPIAIPITIGPGGISTVIIYASAAKTYGDIALIIAAGLVVSAICYAILIVAGKVSRLLGATGLTILNRIMGMMLAAVSVEIIVSGLKMIFPQLAG

SEQ ID NO: 40002 - DNA, 429 bp, Neisseria gonorrhoeae
atgaactttgctttatccgtcatcacatttaccctcgcctctttcctgcccgtcccgcctgccggaaccgccgtctttacttggaaagacggcggcggcaacagctattcggatgtgccgaaacagcttcatcccgaccagagccaaatcctcaacctgcggacgctccaaaccaaaccggcggtcaagcccaaacctgccgtcgatacgaatgcggacagtgcgaaggaaaacgaaaaggatatcgccgagaaaaacgggcagcttgaggaagaaaagaaaaaaattgccgaaaccgaacggcagaacaaagaagaaaactgccggatttcaaaaatgaacctgaaggcggtgggaaactcaaatgcgaaaaacaaggatgatttgatccgtaaatacaataacgccgtaaacaaatactgccgttaa

SEQ ID NO: 40003 - protein, 142 aa, Neisseria gonorrhoeae
MNFALSVITFTLASFLPVPPAGTAVFTWKDGGGNSYSDVPKQLHPDQSQILNLRTLQTKPAVKPKPAVDTNADSAKENEKDIAEKNGQLEEEKKKIAETERQNKEENCRISKMNLKAVGNSNAKNKDDLIRKYNNAVNKYCR

SEQ ID NO: 40004 - DNA, 435 bp, Neisseria meningitidis
atgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaggcggtgggaaattcaaatgcaaaaaacaaggatgatttgattcggaaatacaataacgccgtaaacaaatactgccgttaa

SEQ ID NO: 40005 - protein, 144 aa, Neisseria meningitidis
MNFALSVIMLTLASFLPVPPAGAAVFTWKDGGGNSYSDVPKQLHPDQSQILNLRTRQTKPAVKPAQADAGKRTDGAAQENNPDTAEKNRQLEEEKKRIAETERQNKEENCRISKMNLKAVGNSNAKNKDDLIRKYNNAVNKYCR

SEQ ID NO: 40006 - DNA, 435 bp, Neisseria meningitidis
atgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaagcggtgggaaattcaaatgcaaaaaacaaggatgatttgattcggaaatacaataacgccgtaaacaaatactgccgttaa

SEQ ID NO: 40007 - protein, 144 aa, Neisseria meningitidis; identical to SEQ ID NO: 40005

SEQ ID NO: 40008 - DNA, 897 bp, Neisseria gonorrhoeae
atgccgtctgaaactcgaaatcggtttcagacggcattggtttacgcggcaggttggggcttagcggtctttgtaacggcattcgcttttgcctgcaaaagagtcgccggctttgcgtttgcctttgaagccttcgccggtttttttgaaactgtctttcttaaagccttctttcttgaaaccttcgccgcgcgttttgccgccgaagccttctttgcccggtttatgatcgccgcgccggccgccggatttcctatcgccccagccgcctttgcctttcggcttgccgcctgcggatttgcgtttgcgggccggctccatgccttcgatggtcagttcgggcagtttgcggttaatgtatttttcgattttgtggactttgacgtattcgttcacttcggcaaacgtaatcgcaatacccgtgcggcctgcgcggccggtgcgcccgatgcggtggacgtagtcttccgcctgtttcggcaggtcgtagtttatgacgtgggtaatggtcggtacgtcaataccgcgtgcggcaacgtcggtggcaaccaaaattttgcagcggcctttacgcaaatccgtcagcgtgcggttgcgccagccctgcggcatatcgccgtgcaggcagttggcggcgaaacctttttcgtacaattcatccgcgatgacttcggtcatcgctttggtggacgtgaaaatcacacattggtcgatgttggcatcgcgcaggatgtggtcgagcaggcggtttttgtggcgcatatcgtcgcagtacaacaactgctcttcgattttgccttggccgtccacgcgttcgacttcgataatttcagagtctttggtcagtttgcgcgccagtttgccgactgcgccgtcccaagtggcggagaacaataa

SEQ ID NO: 40009 - protein, 298 aa, Neisseria gonorrhoeae
MPSETRNRFQTALVYAAGWGLAVFVTAFAFACKRVAGFAFAFEAFAGFFETVFLKAFFLETFAARFAAEAFFARFMIAAPAAGFPIAPAAFAFRLAACGFAFAGRLHAFDGQFGQFAVNVFFDFVDFDVFVHFGKRNRNTRAACAAGAPDAVDVVFRLFRQVVVYDVGNGRYVNTACGNVGGNQNFAAAFTQIRQRAVAPALRHIAVQAVGGETFFVQFIRDDFGHRFGGRENHTLVDVGIAQDVVEQAVFVAHIVAVQQLLFDFALAVHAFDFDNFRVFGQFARQFADCAVPSGGEQ

SEQ ID NO: 40010 - DNA, 1275 bp, Neisseria meningitidis
atgccgtctgaaactcgaaatcggtttcagacggcattggtttatgcggcaggttggggcttagcggtctttgtaacggcgttcgcctttgcctgcaaaagaatcgccggctttgcgtttgcctttgaagccttcgccggtttttttgaaaccgtctctcttaaagccttctttcttgaaaccttcgccgcgcgttttgccgccgaagccttctttgctcggtttatgatcgccgcgccaaccgccggatttacgatcgccccagccgcctttgcctttcggcttgccgcctgcggatttgcgtttgcgggtcggttccatgccttcgatggtcagttcgggcagttttcggttaatgtatttttcgattttgtggactttgacgtattcgttcacttcggcaaacgtaatcgcaatacccgtgcggcctgcgcggccggtgcgcccgatgcggtggacgtagtcttccgcctgtttcggcaggtcgtagttgataacgtgggtaatggtcggtacgtcgataccgcgtgcggcaacatcggtggcaaccaaaattttgcagcggcctttacgcaaatccatcagcgtgcggttgcgccagccttgcggcatatcgccgtgcaggcagtttgcggcgaaacctttttcgtacagttcatccgcaatgacttcggtcatggctttggtggacgtgaaaatcacgcattgatcgatattggcatcgcgcaagatatgatcgagcaggcggtttttgtggcgcatatcgtcgcagtacagcagttgttcttcgattttgccttgatcgtccacgcgttcgacttcgatgatttcagggtctttggtcagtttgcgcgccagtttgccgaccgcgccgtcccaagtggcggagaacaacaaagtctgacggtcgctcggcgttgcttccacgatggtttcgatgtcgtcgataaagcccatatccaacatacggtcggcttcgtccaaaatcagcacttccaaacgttcaaaatcaactttgccgctttgcatcaggtccatcagacggcccggcgtggcgacaatcagatcgaccggtttgctcagggcacgggtttggtagccgaaagacgcgccgccgacgatgctgacggtgcggaaccaacgcatatttttggcatacgccagcgcgtttttctcgacttgagccgccagttcgcgggtcggggtcaacaccaaagcacgcgggcctttgcccggtttttcgctgcgtttggtcagtttttgcaaagtcggtaa

SEQ ID NO: 40011 - protein, 424 aa, Neisseria meningitidis
MPSETRNRFQTALVYAAGWGLAVFVTAFAFACKRIAGFAFAFEAFAGFFETVSLKAFFLETFAARFAAEAFFARFMIAAPTAGFTIAPAAFAFRLAACGFAFAGRFHAFDGQFGQFSVNVFFDFVDFDVFVHFGKRNRNTRAACAAGAPDAVDVVFRLFRQVVVDNVGNGRYVDTACGNIGGNQNFAAAFTQIHQRAVAPALRHIAVQAVCGETFFVQFIRNDFGHGFGGRENHALIDIGIAQDMIEQAVFVAHIVAVQQLFFDFALIVHAFDFDDFRVFGQFARQFADRAVPSGGEQQSLTVARRCFHDGFDVVDKAHIQHTVGFVQNQHFQTFKINFAALHQVHQTARRGDNQIDRFAQGTGLVAERRAADDADGAEPTHIFGIRQRVFLDLSRQFAGRGQHQSTRAFARFFAAFGQFLQSR

SEQ ID NO: 40012 - DNA, 1275 bp, Neisseria meningitidis
atgccgtctgaaactcgaaatcggtttcagacggcattggtttatgcggcaggttggggcttagcggtctttgtaacggcgttcgcctttgcctgcaaaagaatcgccggctttgcgtttgcctttgaagccttcgccggtttttttgaaaccgtctctcttaaagccttctttcttgaaaccttcgccgcgcgttttgccgccgaagccttctttgctcggtttatgatcgccgcgccaaccgccggatttacgatcgccccagccgcctttgcctttcggcttgccgcctgcggatttgcgtttgcgggtcggttccatgccttcgatggtcagttcgggcagttttcggttaatgtatttttcgattttgtggactttgacgtattcgttcacttcggcaaacgtaatcgcaatacccgtgcggcctgcgcggccggtgcgcccgatgcggtggacgtagtcttccgcctgtttcggcaggtcgtagttgataacgtgggtaatggtcggtacgtcgataccgcgtgcggcaacgtcggtggcaaccaaaattttgcagcggcctttgcgcaaatccatcagcgtgcggttgcgccagccttgcggcatatcgccgtgcaggcagttggcggcgaaacctttttcgtacaattcatccgcgatgacttcggtcatggctttggtggacgtgaaaatcacgcattgatcgatgtcggcatcgcgcaagatatgatcgagcaggcggtttttgtggcgcatatcgtcgcagtacagcagttgttcttcgattttgccttggtcgtccacgcgttcgacttcgatgatttcagggtctttggtcagtttgcgcgccagtttgccgaccgcgccgtcccaagtggcggagaacaacaaagtctgacggtcttccggcgtggcttcgacgatggtttcgatgtcgtcgataaagcccatatccaacatacggtcggcttcgtccaaaatcagcacttccaagcgggcgaaatcgactttgccgctttgcatcaagtccatcagacggcccggcgtggcgacaatcagatcgaccggtttgctcagggcgcgggtttggtagccgaacgatgcaccaccgacgatgctgacggtacggaaccaacgcatatttttggcatacgccagcgcgtttttctcgacttgagccgccaattcgcgggtcggcgtcaacaccaacgcgcgcgggcctttgcccggtttttcgctgcgtttggtcagtcgctgcaaagtcggtaa

SEQ ID NO: 40013 - protein, 424 aa, Neisseria meningitidis
MPSETRNRFQTALVYAAGWGLAVFVTAFAFACKRIAGFAFAFEAFAGFFETVSLKAFFLETFAARFAAEAFFARFMIAAPTAGFTIAPAAFAFRLAACGFAFAGRFHAFDGQFGQFSVNVFFDFVDFDVFVHFGKRNRNTRAACAAGAPDAVDVVFRLFRQVVVDNVGNGRYVDTACGNVGGNQNFAAAFAQIHQRAVAPALRHIAVQAVGGETFFVQFIRDDFGHGFGGRENHALIDVGIAQDMIEQAVFVAHIVAVQQLFFDFALVVHAFDFDDFRVFGQFARQFADRAVPSGGEQQSLTVFRRGFDDGFDVVDKAHIQHTVGFVQNQHFQAGEIDFAALHQVHQTARRGDNQIDRFAQGAGLVAERCTTDDADGTEPTHIFGIRQRVFLDLSRQFAGRRQHQRARAFARFFAAFGQSLQSR

SEQ ID NO: 40014 - DNA, 4170 bp, Neisseria gonorrhoeae
atgaccgataccacaccgacagataccgatccgaccgaaaacggcacgcgcaaaatgccgtctgaacaccgccccgccccgccggcaaaaaaacgccgcccgctgctgaagctgtcggcggcactgctgtctgtcctgattttggcagtatgtttcctcggctggatcgccggtacggaagcaggtttgcgcttcgggctgtaccaaatcccgtcctggttcggcgtaaacatttcctcccaaaacctcaaaggcacactgctcgacggcttcgacggcgacaactggtcgatagaaaccgagggggcagaccttaaaatcagccgcttccgcttcgcgtggaaaccgtccgaactgatgcgccgcagcctgcacatcaccgacatctccgccggcgacatcgccatcgtaaccaaaccgactccgcctaaagaagaacgcccgcctcaaggcctgcccgacagcatagacctgcccgccgctgtctatctcgaccgcttcgagacgggcaaaatcagcatgggcaaaacctttgacaaacaaaccgtctatctcgaacgcctcaacgcggcataccgttacgaccgtaaagggcaccgcctcgacctgaaggccgccgacacgccgtggagcagttcgtcggggtcagcctcggtcggcttgaaaaaaccgtttgccctcgataccgccatttacaccaaaggcggattcgaaggcgaaaccatacacagtacggcgcggctgagcggcagcctgaaggatgtgcgcgccgaactgacgatcgacggcggcaatatccgcctctcgggaaaatccgtcatccacccgtttgccgaatcattggataaaacattggaagaagtactggtcaaaggattcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttgggcggctttgtcatccggcaggacggcacggtgcatatcggcaatacgtccgccgccctgctcggacggggcggcatcaggctgtcgggcaaaatcgacaccgaaaaagacatccttgatttaaatataggcatcaactccgtcggcgcggaagacgtgctgcaaaccgcgttcaaaggcaggttggacggcagcatcggcatcggcggcacgaccgcctcgcccaaaatctcttggcaactcggcaccggcacggcacgcacggacggcagcctccccatcgcaagcgaccccgcaaacgaacagcggaaactggtgttcgacaccgtcaacatctccgccggggaaggcagcctgaccgcgcaaggctatctcgagctgtttaaagaccgcctgctcaagctggacatccgttcccgcgcattcgacccttcgcgcatcgatccgcaatttccggcaggcaatatcaacggttcgattcatcttgccggtgaactggcaaaagagaaatttacgggcaaaatgcgttttttgcccggtacgttcaacggcgtgccgattgccggcagcgccgacattgtttacgagtcccgccaccttccgcgcgccgccgtcgatttgcggttggggcggaacatcgtcaaaacagacggcggcttcggcaaaaaaggcgaccggcttaacctcaatatcaccgcacccgatttatcccgtttcggtttcggactcgcggggtctttaaatgtacgcggacacctttccggcgatttggacggcggcatccgaacctttgaaaccgacctttccggcacggcgcgcaacttacacatcggcaaagcggcagacatccgttcgctcgattttaccctcaaaggctcacccggcacaagccgcccgatgcgcgccgatatcaagggcggccgcctttccctgtcgggcggcgcggcggttgtcgataccgccggcctgacgctggaaggtacgggcgcgcagcaccgcatccgcacacacgccgccatgacgctggacggcaaaccgttcaaactcgatttggacgcttcaggcggcatcaacagggaacttacccgatggaaaggcagcatcggcatcctcgacatcggcggcgcattcaacctcaagctgcaaaaccgtatgacgctcgaagccggtgcggaacacgtggcggcaagtgcggcaaattggcaggcaatgggcggcagcctcaacctgcaacacttttcttgggacaggaaaaccggcatatcggcaaaaggcggcgcacgcggcctgcacatcgccgagttgcacaatttcttcaaaccgcccttcgaacacaatctggttttaaacggcgactgggatgtcgcctacgggcacaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcggacggattaacgccgatttgggcatcggcaacgccttcggcggcaatatggcaaatacaccgctcggcggcaggattacagcctcccttcccgacttgggcgcattgaagccctttctgcccgccgccgcgcaaaacattaccggcagcctgaatgcctccgcgcaaatcggcggacgggtaggctctccgtccgtcaatgccgccgtcaacggtagcagcaactacgggaaaatcaacggcaatatcaccgtcgggcaaagccgctccttcgataccgcacctttgggcggcaggctcaacctgaccgttgccgatgccgaagcattccgcaacttcctaccggtcggacaaaccgtcaaaggcagcctgaatgccgccgtaaccctcggcggcagcatcgccgacccgcacttgggcggcagtatcaacggcgacaagctctattaccgcaaccaaacccaaggcatcatcttggacaacggctcgctgcgttcgcatattgcaggcaggaaatgggtaatcgacagcctgaaattccggcacgaagggacggcggaactctccggcacggtcagcatggaaaacagcgtgcccgatgtcgatatcggcgcggtgttcgacaaataccgcatcctgtcccgccccaaccgccgcctgacggtttccggcaacacccgcctgcgctattcgccgcaaaaaggcatatccgttaccggtatgattaaaactgatcaggggctgttcggttcgcaaaaatcctcgatgccgtccgtcggcgacgatgtcgtcgtattgggcgaagtcaagaaagaggcggcggcatcgctccccgtcaatatgaacctgactttagacctcaatgacggcatccgcttctccggctacggcgcggacgttaccataggcggcaaactgaccctgaccgcgcaaccgggcggaaatgtgcgtggggtgggcacggtccgcgtcatcaaagggcgttacaaagcatacgggcaggatttagacattaccaaaggcacagtctcctttgtcggcccgctcaacgaccccaacctgaacatccgcgccgaacgccgcctttcccccgtcggtgcgggcgtggaaatattgggcagcctcaacagcccgcgcattacgctgacggcaaacgaaccgatgagtgaaaaagacaagctctcctggctcatcctcaaccgtgccggcagcggcagcagcggcgacaatgccgccctgtccgcagccgcaggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacggcatctccagcgcggaacagtccgtcaaactgatttaccggctgacccgcgccatacaggcggttgcccgtatcggcagccgttcgtcgggcggcgagctgacatacaccatacgtttcgaccgcctcttcggttcggacaaaaaagactccgcaggaaacggcaaagggaaataa

SEQ ID NO: 40015 - protein, 1389 aa, Neisseria gonorrhoeae
MTDTTPTDTDPTENGTRKMPSEHRPAPPAKKRRPLLKLSAALLSVLILAVCFLGWIAGTEAGLRFGLYQIPSWFGVNISSQNLKGTLLDGFDGDNWSIETEGADLKISRFRFAWKPSELMRRSLHITDISAGDIAIVTKPTPPKEERPPQGLPDSIDLPAAVYLDRFETGKISMGKTFDKQTVYLERLNAAYRYDRKGHRLDLKAADTPWSSSSGSASVGLKKPFALDTAIYTKGGFEGETIHSTARLSGSLKDVRAELTIDGGNIRLSGKSVIHPFAESLDKTLEEVLVKGFNINPSAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGTGTARTDGSLPIASDPANEQRKLVFDTVNISAGEGSLTAQGYLELFKDRLLKLDIRSRAFDPSRIDPQFPAGNINGSIHLAGELAKEKFTGKMRFLPGTFNGVPIAGSADIVYESRHLPRAAVDLRLGRNIVKTDGGFGKKGDRLNLNITAPDLSRFGFGLAGSLNVRGHLSGDLDGGIRTFETDLSGTARNLHIGKAADIRSLDFTLKGSPGTSRPMRADIKGGRLSLSGGAAVVDTAGLTLEGTGAQHRIRTHAAMTLDGKPFKLDLDASGGINRELTRWKGSIGILDIGGAFNLKLQNRMTLEAGAEHVAASAANWQAMGGSLNLQHFSWDRKTGISAKGGARGLHIAELHNFFKPPFEHNLVLNGDWDVAYGHNARGYLNISRQSGDAVLPGGQALGLNAFSLKTRFQNDRIGILLDGGARFGRINADLGIGNAFGGNMANTPLGGRITASLPDLGALKPFLPAAAQNITGSLNASAQIGGRVGSPSVNAAVNGSSNYGKINGNITVGQSRSFDTAPLGGRLNLTVADAEAFRNFLPVGQTVKGSLNAAVTLGGSIADPHLGGSINGDKLYYRNQTQGIILDNGSLRSHIAGRKWVIDSLKFRHEGTAELSGTVSMENSVPDVDIGAVFDKYRILSRPNRRLTVSGNTRLRYSPQKGISVTGMIKTDQGLFGSQKSSMPSVGDDVVVLGEVKKEAAASLPVNMNLTLDLNDGIRFSGYGADVTIGGKLTLTAQPGGNVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYGISSAEQSVKLIYRLTRAIQAVARIGSRSSGGELTYTIRFDRLFGSDKKDSAGNGKGK

SEQ ID NO: 40016 - DNA, 4170 bp, Neisseria meningitidis
atgaccgataccgcaccgacagataccgatccgaccgaaaacggcacgcgcaaaatgccgtctgaacaccgccctaccccgccggcaaaaaaacgccgcccgttgctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataa

SEQ ID NO: 40017 - protein, 1389 aa, Neisseria meningitidis
MTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 40018 - DNA, 4170 bp, Neisseria meningitidis
atgaccgataccgcaccgacagataccgatccgaccgaaaacggcacgcgcaaaatgccgtctgaacaccgccctaccccgccggcaaaaaaacgccgcccgctgctgaagctgtcggcggcactgctgtctgttctgattttggcagtatgtttcctcggctggctcgccggcacggaagcgggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgcctcgacctgaaggctgccgacacgccgtggagcagttcgtcggggtcagcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttaggcagctttgtcatccggcaggacggcacggtgcatatcggcaatacgtccgtcgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgaccccgcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggcgatttggacggtggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggaggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgaaacgcgcgcggctacctcaatatcagccggcaaagcggcgatgccgtattgcccggcgggcaggctttgggtttgaacgcattttccctgaaaacgcgctttcaaaacgaccgtatcggaatcctgcttgacggcggcgcgcgtttcgggcggattaacgccgatttggacatcggcaacgccttcggcggcaatatggcaaatgcaccgctcggcggcaggattaccgcctcccttcccgacttgggcacattgaagccctttctgcccgccgccgcgcaaaacattaccggcagcctgaatgccgccgcgcaaatcggcggacgggtcggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtgcggggcgtgggcacggtccgcgtcatcaaagggcgttataaggcatacgggcaggatttggacattaccaaaggcacggtctcctttgtcggcccgctcaacgaccccaacctcaacatccgcgccgaacgccgcctttcccccgtcggtgcgggcgtggaaatattgggcagcctcaacagtccgcgcattacgctgacggcaaacgaaccgatgagtgaaaaagacaagctctcctggctcatcctcaaccgcgccggcagtggcagcagcggcgacaatgccgccctgtccgcagccgccggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacagcaaaggaaaataa

SEQ ID NO: 40019 - protein, 1389 aa, Neisseria meningitidis
MTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGSASVGLKKPFALDTAIYTKGGLEGKTIHSTARLSGSLKDVRAELAIDGGNIRLSGKSVIHPFAESLDKTLEEVLVKGFNINPSAFVPSLPDAGLNFDLTAIPSFSDGIALEGSLDLENTKAGFADRNGIPVRQVLGSFVIRQDGTVHIGNTSVALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAEVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLDIGNAFGGNMANAPLGGRITASLPDLGTLKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNSKGK

SEQ ID NO: 40020 - DNA, 4065 bp, Neisseria gonorrhoeae
ctgaagctgtcggcggcactgctgtctgtcctgattttggcagtatgtttcctcggctggatcgccggtacggaagcaggtttgcgcttcgggctgtaccaaatcccgtcctggttcggcgtaaacatttcctcccaaaacctcaaaggcacactgctcgacggcttcgacggcgacaactggtcgatagaaaccgagggggcagaccttaaaatcagccgcttccgcttcgcgtggaaaccgtccgaactgatgcgccgcagcctgcacatcaccgacatctccgccggcgacatcgccatcgtaaccaaaccgactccgcctaaagaagaacgcccgcctcaaggcctgcccgacagcatagacctgcccgccgccgtctatctcgaccgcttcgagacgggcaaaatcagcatgggcaaaacctttgacaaacaaaccgtctatctcgaacgcctcaacgcggcataccgttacgaccgtaaagggcaccgcctcgacctgaaggccgccgacacgccgtggagcagttcgtcggggtcagcctcggtcggcttgaaaaaaccgtttgccctcgataccgccatttacaccaaaggcggattcgaaggcgaaaccatacacagtacggcgcggctgagcggcagcctgaaggatgtgcgcgccgaactgacgatcgacggcggcaatatccgcctctcgggaaaatccgtcatccacccgtttgccgaatcattggataaaacattggaagaagtactggtcaaaggattcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttgggcggctttgtcatccggcaggacggcacggtgcatatcggcaatacgtccgccgccctgctcggacggggcggcatcaggctgtcgggcaaaatcgacaccgaaaaagacatccttgatttaaatataggcatcaactccgtcggcgcggaagacgtgctgcaaaccgcgttcaaaggcaggttggacggcagcatcggcatcggcggcacgaccgcctcgcccaaaatctcttggcaactcggcaccggcacggcacgcacggacggcagcctcgccatcgcaagcgaccccgcaaacgaacagcggaaactggtgttcgacaccgtcaacatctccgccggggaaggcagcctgaccgcgcaaggctatctcgagctgtttaaagaccgcctgctcaagctggacatccgttcccgcgcattcgacccttcgcgcatcgatccgcaatttccggcaggcgatatcaacggttcgattcatcttgccggtgaactggcaaaagagaaatttacgggcaaaatgcgttttttgcccggtacgttcaacggcgtgccgattgccggcagcgccgacattgtttacgagtcccgccaccttccgcgcgccgccgtcgatttgcggttggggcggaacatcgtcaaaacagacggcggcttcggcaaaaaaggcgaccggcttaacctcaatatcaccgcacccgatttatcccgtttcggtttcggactcgcggggtctttaaatgtacgcggacacctttccggcgatttggacggcggcatccgaacctttgaaaccgacctttccggcacggcgcgcaacttacacatcggcaaagcggcagacatccgttcgctcgattttaccctcaaaggctcacccggcacaagccgcccgatgcgcgccgatatcaagggcggccgcctttccctgtcgggcggcgcggcggttgtcgataccgccggcctgacgctggaaggtacgggcgcgcagcaccgcatccgcacacacgccgccatgacgctggacggcaaaccgttcaaactcgatttggacgcttcaggcggcatcaacagggaacttacccgatggaaaggcagcatcggcatcctcgacatcggcggcgcattcaacctcaagctgcaaaaccgtatgacgctcgaagccggtgcggaacacgtggcggcaagtgcggcaaattggcaggcaatgggcggcagcctcaacctgcaacacttttcttgggacaggaaaaccggcatatcggcaaaaggcggcgcacgcggcctgcacatcgccgagttgcacaatttcttcaaaccgcccttcgaacacaatctggttttaaacggcgactgggatgtcgcctacgggcacaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcggacggattaacgccgatttgggcatcggcaacgccttcggcggcaatatggcaaatacaccgctcggcggcaggattacagcctcccttcccgacttgggcgcattgaagccctttctgcccgccgccgcgcaaaacattaccggcagcctgaatgcctccgcgcaaatcggcggacgggtaggctctccgtccgtcaatgccgccgtcaacggtagcagcaactacgggaaaatcaacggcaatatcaccgtcgggcaaagccgctccttcgataccgcacctttgggcggcaggctcaacctgaccgttgccgatgccgaagcattccgcaacttcctaccggtcggacaaaccgtcaaaggcagcctgaatgccgccgtaaccctcggcggcagcatcgccgacccgcacttgggcggcagtatcaacggcgacaagctctattaccgcaaccaaacccaaggcatcatcttggacaacggctcgctgcgttcgcatattgcaggcaggaaatgggtaatcgacagcctgaaattccggcacgaagggacggcggaactctccggcacggtcagcatggaaaacagcgtgcccgatgtcgatatcggcgcggtgttcgacaaataccgcatcctgtcccgccccaaccgccgcctgacggtttccggcaacacccgcctgcgctattcgccgcaaaaaggcatatccgttaccggtatgattaaaactgatcaggggctgttcggttcgcaaaaatcctcgatgccgtccgtcggcgacgatgtcgtcgtattgggcgaagtcaagaaagaggcggcggcatcgctccccgtcaatatgaacctgactttagacctcaatgacggcatccgcttctccggctacggcgcggacgttaccataggcggcaaactgaccctgaccgcgcaaccgggcggaaatgtgcgtggggtgggcacggtccgcgtcatcaaagggcgttacaaagcatacgggcaggatttagacattaccaaaggcacagtctcctttgtcggcccgctcaacgaccccaacctgaacatccgcgccgaacgccgcctttcccccgtcggtgcgggcgtggaaatattgggcagcctcaacagcccgcgcattacgctgacggcaaacgaaccgatgagtgaaaaagacaagctctcctggctcatcctcaaccgtgccggcagcggcagcagcggcgacaatgccgccctgtccgcagccgcaggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacggcatctccagcgcggaacagtccgtcaaactgatttaccggctgacccgcgccatacaggcggttgcccgtatcggcagccgttcgtcgggcggcgagctgacatacaccatacgtttcgaccgcctcttcggttcggacaaaaaagactccgcaggaaacggcaaagggaaataa

SEQ ID NO: 40021 - protein, 1354 aa, Neisseria gonorrhoeae
LKLSAALLSVLILAVCFLGWIAGTEAGLRFGLYQIPSWFGVNISSQNLKGTLLDGFDGDNWSIETEGADLKISRFRFAWKPSELMRRSLHITDISAGDIAIVTKPTPPKEERPPQGLPDSIDLPAAVYLDRFETGKISMGKTFDKQTVYLERLNAAYRYDRKGHRLDLKAADTPWSSSSGSASVGLKKPFALDTAIYTKGGFEGETIHSTARLSGSLKDVRAELTIDGGNIRLSGKSVIHPFAESLDKTLEEVLVKGFNINPSAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGTGTARTDGSLAIASDPANEQRKLVFDTVNISAGEGSLTAQGYLELFKDRLLKLDIRSRAFDPSRIDPQFPAGDINGSIHLAGELAKEKFTGKMRFLPGTFNGVPIAGSADIVYESRHLPRAAVDLRLGRNIVKTDGGFGKKGDRLNLNITAPDLSRFGFGLAGSLNVRGHLSGDLDGGIRTFETDLSGTARNLHIGKAADIRSLDFTLKGSPGTSRPMRADIKGGRLSLSGGAAVVDTAGLTLEGTGAQHRIRTHAAMTLDGKPFKLDLDASGGINRELTRWKGSIGILDIGGAFNLKLQNRMTLEAGAEHVAASAANWQAMGGSLNLQHFSWDRKTGISAKGGARGLHIAELHNFFKPPFEHNLVLNGDWDVAYGHNARGYLNISRQSGDAVLPGGQALGLNAFSLKTRFQNDRIGILLDGGARFGRINADLGIGNAFGGNMANTPLGGRITASLPDLGALKPFLPAAAQNITGSLNASAQIGGRVGSPSVNAAVNGSSNYGKINGNITVGQSRSFDTAPLGGRLNLTVADAEAFRNFLPVGQTVKGSLNAAVTLGGSIADPHLGGSINGDKLYYRNQTQGIILDNGSLRSHIAGRKWVIDSLKFRHEGTAELSGTVSMENSVPDVDIGAVFDKYRILSRPNRRLTVSGNTRLRYSPQKGISVTGMIKTDQGLFGSQKSSMPSVGDDVVVLGEVKKEAAASLPVNMNLTLDLNDGIRFSGYGADVTIGGKLTLTAQPGGNVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYGISSAEQSVKLIYRLTRAIQAVARIGSRSSGGELTYTIRFDRLFGSDKKDSAGNGKGK

SEQ ID NO: 40022 - DNA, 4065 bp, Neisseria meningitidis
ctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataa

SEQ ID NO: 40023 - protein, 1354 aa, Neisseria meningitidis
LKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 40024 - DNA, 4065 bp, Neisseria meningitidis
ctgaagctgtcggcggcactgctgtctgttctgattttggcagtatgtttcctcggctggctcgccggcacggaagcgggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgcctcgacctgaaggctgccgacacgccgtggagcagttcgtcggggtcagcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttaggcagctttgtcatccggcaggacggcacggtgcatatcggcaatacgtccgtcgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgaccccgcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggcgatttggacggtggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggaggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgaaacgcgcgcggctacctcaatatcagccggcaaagcggcgatgccgtattgcccggcgggcaggctttgggtttgaacgcattttccctgaaaacgcgctttcaaaacgaccgtatcggaatcctgcttgacggcggcgcgcgtttcgggcggattaacgccgatttggacatcggcaacgccttcggcggcaatatggcaaatgcaccgctcggcggcaggattaccgcctcccttcccgacttgggcacattgaagccctttctgcccgccgccgcgcaaaacattaccggcagcctgaatgccgccgcgcaaatcggcggacgggtcggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtgcggggcgtgggcacggtccgcgtcatcaaagggcgttataaggcatacgggcaggatttggacattaccaaaggcacggtctcctttgtcggcccgctcaacgaccccaacctcaacatccgcgccgaacgccgcctttcccccgtcggtgcgggcgtggaaatattgggcagcctcaacagtccgcgcattacgctgacggcaaacgaaccgatgagtgaaaaagacaagctctcctggctcatcctcaaccgcgccggcagtggcagcagcggcgacaatgccgccctgtccgcagccgccggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacagcaaaggaaaataa

SEQ ID NO: 40025 - protein, 1354 aa, Neisseria meningitidis
LKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGSASVGLKKPFALDTAIYTKGGLEGKTIHSTARLSGSLKDVRAELAIDGGNIRLSGKSVIHPFAESLDKTLEEVLVKGFNINPSAFVPSLPDAGLNFDLTAIPSFSDGIALEGSLDLENTKAGFADRNGIPVRQVLGSFVIRQDGTVHIGNTSVALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAEVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLDIGNAFGGNMANAPLGGRITASLPDLGTLKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNSKGK

SEQ ID NO: 40026 - DNA, 1569 bp, Neisseria gonorrhoeae
atgcagaacaccggtaccatgatgatcaaaccgaccgccctgctcctgccggctttatttttctttccgcacgcatacgcgcctgccgccgacctttccgaaaacaaggcggcgggtttcgcattgttcaaaagcaaaagccccgacaccgaatcagtcaaattaaaacccaaattccccgtccgcatcgacacgcaggacagtgaaatcaaagatatggtcgaagaacacctgccgctcatcacgcagcagcaggaagaggttttggataaggaacagacgggattccttgccgaagaagcaccggacaacgttaaaacaatgctccgcagcaaaggctatttcagcagcaaggtcagcctgacggaaaaagacggagcttatacggtgcacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaaggctacccgcttgccaagctcggcaacacccgggcggccgtcaaccccgataccgccaccgccgatttgaacgtcgtcgtggacagcggccgccccattgccttcggcgactttgaaatcaccggcacacagcgttaccccgaacaaaccgtctccggcctggcgcgcttccaaccgggcacgccctacgacctcgacctgctgctcgacttccaacaggcgctcgaacaaaacgggcattattccggcgcgtccgtacaagccgacttcgaccgcctcccaaggggaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggctcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcatctggtatgtgcgcgaccgcgcgggcatcgatgccaggctgggggcggaatttctcgcagaaggccggaaaatccccggctcggatgtcgatttgggcaacagccacgccacgatgctgaccgcctcttggaaacgccagctgctcaacaacgtgctgcaccccgaaaacggccattacctcgacggcaaaatcgggacgactttgggcacattcctgtcctccaccgcgctaatccgcacctctgcccgcgcaggttatttcttcacgcccgaaaacaaaaaactcggcacgttcatcatacgcggacaagcgggttacaccgttgcacgcgacaatgccgatgtcccctcggggctgatgttccgcagcggcggcgcgtcttccgtgcgcggttacgaacttga

SEQ ID NO: 40027 - protein, 522 aa, Neisseria gonorrhoeae
MQNTGTMMIKPTALLLPALFFFPHAYAPAADLSENKAAGFALFKSKSPDTESVKLKPKFPVRIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKGYPLAKLGNTRAAVNPDTATADLNVVVDSGRPIAFGDFEITGTQRYPEQTVSGLARFQPGTPYDLDLLLDFQQALEQNGHYSGASVQADFDRLPRGPRPRQSQRNRGQTPQTRNRHPPRFGIRFGRQNRLRLLQPLQQRLYRLGRLGYGQIRNHACRRHQPAAQLSGQLLDKQRFLQPFDHPKPRKTRLLRRHLVCARPRGHRCQAGGGISRRRPENPRLGCRFGQQPRHDADRLLETPAAQQRAAPRKRPLPRRQNRDDFGHIPVLHRANPHLCPRRLFLHARKQKTRHVHHTRTSGLHRCTRQCRCPLGADVPQRRRVFRARLRT

SEQ ID NO: 40028 - DNA, 1848 bp, Neisseria meningitidis
atgcacgacacccgtaccatgatgatcaaaccgaccgccctgctcctgccggctttatttttctttccgcacgcatacgcgcctgccgccgacctttccgaaaacaaggcggcgggtttcgcattgttcaaaaacaaaagccccgacaccgaatcagtcaaattaaaacccaaattccccgtcctcatcgacacgcaggacagtgaaatcaaagatatggtcgaagaacacctgccgctcatcacgcagcagcaggaagaagtattggacaaggaacagacgggcttcctcgccgaagaagcgccggacaacgttaaaacgatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaagcctacccgcttgccaagctcggcaatacgcaggcggccgtcaaccccgataccgccaccgccgatttgaacgtcgtcgtggacagcggccgccccatcgccttcggcgactttgaaatcaccggcacacagcgttaccccgaacaaatcgtctccggccttgcgcgtttccagcccggtatgccgtacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcgtctggtatgtgcgcgaccgcgcgggcatcgatgccaggctgggggcggaatttctcgcagaaggccggaaaatccccggctcggctgtcgatttgggcaacagccacgccacgatgctgaccgcctcttggaaacgccagctgctcaacaacgtgctgcatcccgaaaacggccattacctcgacggcaaaatcggtacgactttgggcacattcctgtcctccaccgcgctgatccgcacctctgcccgtgcaggttatttcttcacgcccgaaaacaaaaaactcggcacgttcatcatacgcggacaagcgggttacaccgttgcccgcgacaatgccgacgttccttcagggctgatgttccgcagcggcggcgcgtcttccgtgcgcggttacgaactcgacagcatcggacttgccggcccgaacggatcggtcctgcccgaacgcgccctcctggtgggcagcctggaataccaactgccgtttacgcgcaccctttccggcgcggtgttccacgatatgggcgatgccgccgccaatttcaaacgtatgaagctgaaacacggttcgggactgggcgtgcgctggttcagcccgcttgcgccgttttccttcgacatcgcctacgggcacagcgataagaaaatccgctggcacatcagcttgggaacgcgcttctaa

SEQ ID NO: 40029 - protein, 615 aa, Neisseria meningitidis
MHDTRTMMIKPTALLLPALFFFPHAYAPAADLSENKAAGFALFKNKSPDTESVKLKPKFPVLIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTQAAVNPDTATADLNVVVDSGRPIAFGDFEITGTQRYPEQIVSGLARFQPGMPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGVWYVRDRAGIDARLGAEFLAEGRKIPGSAVDLGNSHATMLTASWKRQLLNNVLHPENGHYLDGKIGTTLGTFLSSTALIRTSARAGYFFTPENKKLGTFIIRGQAGYTVARDNADVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 40030 - DNA, 1848 bp, Neisseria meningitidis
atgcacgacacccgtaccatgatgattaaaccgaccgccctgctcctgccggctttatttttctttccgcacgcatacgcgcctgccgccgacctttccgaaaacaaggcggcgggtttcgcattgttcaaaaacaaaagccccgacaccgaatcagttaaattaaaacccaaattccccgtccgcatcgacacgcaggatagtgaaatcaaagatatggtcgaagaacacctgccgctcatcacgcagcagcaggaagaagtattggacaaggaacagacgggcttcctcgccgaagaagcaccggacaacgttaaaacaatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagtgatttcgatcaggacagttgggaaaacagcaaaacttccgtcctcggcgcggtaacgcgcaaagcctacccgcttgccaagctcggcaacacccgggcggccgtcaaccccgataccgccaccgccgatttgaacgtcgtcgtggacagcggccgccccatcgccttcggcgactttgaaattaccggcacgcagcgttaccccgaacaaatcgtctccggcttggcgcgcttccaaccgggcacgccctacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaagctcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcatctggtatgtgcgcgaccgcgcgggcatcgatgccaggctgggggcggagtttctcgcagaaggccggaaaatccccggctcggatatcgatttgggcaacagccacgccacgatgctgaccgcctcttggaaacgccagctgctcaacaacgtgctgcatcccgaaaacggccattacctcgacggcaaaatcggtacgactttgggcgcattcctgtcctccaccgcgctgatccgcacctctgcccgcgcaggttatttcttcacgcccgaaaacaaaaaactcggcacgttcatcatacgcggacaagcgggttacaccgttgcccgcgacaatgccaacgttccttcagggctgatgttccgcagcggcggcgcgtcttccgtgcgcggttacgaactcgacagcatcgggcttgccggcccgaacggatcggtcctgcccgaacgcgccctcttggtgggcagcctggaataccaactgccgtttacgcgcaccctttccggcgcggtgttccacgatatgggcgacgccgccgccaatttcaaacgtatgaagctgaaacacggttcgggactgggcgtgcgctggttcagcccgctcgcgccgttttccttcgacatcgcctacgggcacagcgacaagaaaatccgctggcacatcagcttgggaacgcgcttctaa

SEQ ID NO: 40031 - protein, 615 aa, Neisseria meningitidis
MHDTRTMMIKPTALLLPALFFFPHAYAPAADLSENKAAGFALFKNKSPDTESVKLKPKFPVRIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTRAAVNPDTATADLNVVVDSGRPIAFGDFEITGTQRYPEQIVSGLARFQPGTPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGIWYVRDRAGIDARLGAEFLAEGRKIPGSDIDLGNSHATMLTASWKRQLLNNVLHPENGHYLDGKIGTTLGAFLSSTALIRTSARAGYFFTPENKKLGTFIIRGQAGYTVARDNANVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 40032 - DNA, 1290 bp, Neisseria gonorrhoeae; identical to SEQ ID NO: 38795

SEQ ID NO: 40033 - protein, 429 aa, Neisseria gonorrhoeae; identical to SEQ ID NO: 38796

SEQ ID NO: 40034 - DNA, 1467 bp, Neisseria meningitidis; identical to SEQ ID NO: 38793

SEQ ID NO: 40035 - protein, 488 aa, Neisseria meningitidis; identical to SEQ ID NO: 38794

SEQ ID NO: 40036 - DNA, 1494 bp, Neisseria meningitidis; identical to SEQ ID NO: 38797

SEQ ID NO: 40037 - protein, 497 aa, Neisseria meningitidis; identical to SEQ ID NO: 38798

SEQ ID NO: 40038 - DNA, 549 bp, Neisseria gonorrhoeae
atgcacaccggacaggcggtaagccgggttctgtctcggacagtcattcctctaggcataccgttgccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttgcctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacgcaaaaatgccgtctgaaacggtacaggtttcagacggcatacagcctaaactacacaccctgtttcaggctggcttcgatgaagccgtccaagtcgccgtccaatacggctttgtggttgccgacttcgtagcctgtacgcaagtctttgatgcgtga

SEQ ID NO: 40039 - protein, 182 aa, Neisseria gonorrhoeae
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNAKMPSETVQVSDGIQPKLHTLFQAGFDEAVQVAVQYGFVVADFVACTQVFDA

SEQ ID NO: 40040 - DNA, 549 bp, Neisseria meningitidis
atgcacaccggacaggcggtaagccgggttctgtctcggacagtcattcctctaggcataccgttaccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttacctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacacaaaaatgccgtctgaaacggtacaggtttcagacggcatacagcctaaactacacgccctgtttcaggctggcttcgatgaagccgtccaagtcgccatccaatacggctttggtgttgccgacttcgtagcctgtacgcaagtctttgatacgtga

SEQ ID NO: 40041 - protein, 182 aa, Neisseria meningitidis
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNTKMPSETVQVSDGIQPKLHALFQAGFDEAVQVAIQYGFGVADFVACTQVFDT

SEQ ID NO: 40042 - DNA, 549 bp, Neisseria meningitidis
atgcacaccggacaggcggtaagccgggttctgtctcggacagtcattcctctaggcataccgttgccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttgcctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacgcaaaaatgccgtctgaaacggtacaggtttcagacggcatacagcctaaactacacgccctgtttcaggctggcttcgataaagccgtccaagtcgccgtccaatacggctttggtgttgccgacttcgtagcctgtgcgcaagtctttaatgcgtga

SEQ ID NO: 40043 - protein, 182 aa, Neisseria meningitidis
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNAKMPSETVQVSDGIQPKLHALFQAGFDKAVQVAVQYGFGVADFVACAQVFNA

SEQ ID NO: 40044 - DNA, 1179 bp, Neisseria gonorrhoeae
atggcaaaaatgatgaaatgggcggctgttgcggcggtcgcggcggcagcggtttggggcggatggtcttatctgaagcccgaaccgcaggctgcttatattacggaagcggtcaggcgcggcgatatcagccggacggtttccgcgacgggcgagatttcgccgtccaacctggtatcggtcggcgcgcaggcttcggggcagattaaaaagctttatgtcaaactcgggcaacaggtcaaaaagggcgatttgattgcggaaatcaattcgaccacgcagaccaacacgatcgatatggaaaaatccaaattggaaacgtatcaggcgaagctggtgtccgcacagattgcattgggcagcgcggaaaaaaaatataagcgtcaggcggcgttgtggaaggatgatgcgacctctaaagaagatttggaaagcgcgcaggatgcgcttgccgccgccaaagccaatgttgccgagttgaaggctttaatcagacagagcaaaatttccatcaataccgccgagtcggatttgggctacacgcgcattaccgcgacgatggacggcacggtggtggcgattcccgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctattattatgcccgttcgtttgtgccgaatccggacggcaaactcgccacggggatgacgacgcagaatacggttgaaatcgacggtgtgaaaaatgtgttgcttattccgtcgctgaccgtgaaaaatcgcggcggcaaggcgttcgtacgcgtgttgggtgcggacggcaaggcagtggaacgcgaaatccggaccggtatgaaagacagtatgaataccgaagtgaaaagcgggttgaaagagggggacaaagtggtcatctccgaaataaccgccgccgagcagcaggaaagcggcgaacgcgccctaggcggcccgccgcgccgataa

SEQ ID NO: 40045 - protein, 392 aa, Neisseria gonorrhoeae
MAKMMKWAAVAAVAAAAVWGGWSYLKPEPQAAYITEAVRRGDISRTVSATGEISPSNLVSVGAQASGQIKKLYVKLGQQVKKGDLIAEINSTTQTNTIDMEKSKLETYQAKLVSAQIALGSAEKKYKRQAALWKDDATSKEDLESAQDALAAAKANVAELKALIRQSKISINTAESDLGYTRITATMDGTVVAIPVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLLIPSLTVKNRGGKAFVRVLGADGKAVEREIRTGMKDSMNTEVKSGLKEGDKVVISEITAAEQQESGERALGGPPRR

SEQ ID NO: 40046 - DNA, 1005 bp, Neisseria meningitidis
gtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataa

SEQ ID NO: 40047 - protein, 334 aa, Neisseria meningitidis
VSVGAQASGQIKILYVKLGQQVKKGDLIAEINSTSQTNTLNTEKSKLETYQAKLVSAQIALGSAEKKYKRQAALWKENATSKEDLESAQDAFAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 40048 - DNA, 1179 bp, Neisseria meningitidis
atggcaaaaatgatgaaatgggcggctgttgcggcggtcgcggcggcagcggtttggggcggatggtcttatctgaagcccgagccgcaggctgcttatattacggaaacggtcaggcgcggcgacatcagccggacggtttctgcaacaggggagatttcgccgtccaacctggtatcggtcggcgcgcaggcatcggggcagattaagaaactttatgtcaaactcgggcaacaggttaaaaagggcgatttgattgcggaaatcaattcgacctcgcagaccaatacgctcaatacggaaaaatccaaattggaaacgtatcaggcgaagctggtgtcggcacagattgcattgggcagcgcggagaagaaatataagcgtcaggcggcgttgtggaaggatgatgcgaccgctaaagaagatttggaaagcgcacaggatgcgcttgccgccgccaaagccaatgttgccgagctgaaggctctaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctactattatgcccgttcgtttgtgccgaatccggacggcaaactcgccacggggatgacgacgcagaatacggttgaaatcgacggtgtgaaaaatgtgctgattattccgtcgctgaccgtgaaaaatcgcggcggcagggcgtttgtgcgcgtgttgggtgcagacggcaaggcggcggaacgcgaaatccggaccggtatgagagacagtatgaataccgaagtaaaaagcgggttgaaagagggggacaaagtggtcatctccgaaataaccgccgccgagcagcaggaaagcggcgaacgcgccctaggcggcccgccgcgccgataa

SEQ ID NO: 40049 - protein, 392 aa, Neisseria meningitidis
MAKMMKWAAVAAVAAAAVWGGWSYLKPEPQAAYITETVRRGDISRTVSATGEISPSNLVSVGAQASGQIKKLYVKLGQQVKKGDLIAEINSTSQTNTLNTEKSKLETYQAKLVSAQIALGSAEKKYKRQAALWKDDATAKEDLESAQDALAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGRAFVRVLGADGKAAEREIRTGMRDSMNTEVKSGLKEGDKVVISEITAAEQQESGERALGGPPRR

SEQ ID NO: 40050 - DNA, 798 bp, Neisseria gonorrhoeae
atgaaaaccaagttaatcaaaatcttgaccccctttaccgtcctgccgctgctggcttgcgggcaaacgcccgtttccaatgccaacgccgaatccgccgtcaaagccgaatccgccggcaaatccgttgccgcttctttgaaagcgcgtttggaaaaaacctattccgcccaagatttgaaagtgttgagcgtcagcgaaacaccggtcaaaggcatttacgaagtcgtcgtcagcggcaggcagattatctacaccgatgccgaaggcggctatatgttcgtcggcgaactcatcaacatcgacacgcgcaaaaacctgaccgaagaacgcgccgccgatttgaacaaaatcgacttcgcctccctgcctttggacaaagccatcaaagaagtacgcggcaacggcaagctgaaagtcgccgtcttctccgaccccgattgtccgttctgcaaacgcttggaacatgagtttgaaaaaatgaccgacgtgacggtttacagctttatgatgcccattgccggcctgcacccagatgccgcgcgcaaggcgcaaatcttatggtgtcagcccgaccgtgccaaagcgtggacggattggatgcgtaaaggcaaattcccggtcggcggcagcatctgcgacaatcccgtcgcggaaaccacttccttgggcgaacagttcggcttcaacggcacgccgacccttcgtcttccccaacgggcgcacccaaagcggttacagcccgatgccccaactggaggaaatcatccgcaaaaaccagcagtaaacccgcaatga

SEQ ID NO: 40051 - protein, 265 aa, Neisseria gonorrhoeae
MKTKLIKILTPFTVLPLLACGQTPVSNANAESAVKAESAGKSVAASLKARLEKTYSAQDLKVLSVSETPVKGIYEVVVSGRQIIYTDAEGGYMFVGELINIDTRKNLTEERAADLNKIDFASLPLDKAIKEVRGNGKLKVAVFSDPDCPFCKRLEHEFEKMTDVTVYSFMMPIAGLHPDAARKAQILWCQPDRAKAWTDWMRKGKFPVGGSICDNPVAETTSLGEQFGFNGTPTLRLPQRAHPKRLQPDAPTGGNHPQKPAVNPQ

SEQ ID NO: 40052 - DNA, 783 bp, Neisseria meningitidis
atgaaaaccaagttaatcaaaatcttgaccccctttaccgtcctcccgctgctggcttgcgggcaaacgcccgtttccaatgccaacgccgaacccgccgtcaaagccgagtccgccggcaaatccgttgccgcctctttgaaagcgcgtttggaaaaaacctattccgcccaagatttgaaagtgttgagcgtcagcgaaacaccggtcaaaggcatttacgaagtcgtcgtcagcggcaggcagattatctacaccgatgccgaaggcggctatatgttcgtcggcgaactcatcaacatcgacacgcgcaaaaacctgaccgaagaacgcgccgccgatttgaacaaaatcgacttcgcctccctgcctttggacaaagccatcaaagaagtgcgcggcaacggcaagctgaaagtcgccgtcttctccgaccccgattgtccgttctgcaaacgcttggaacacgagtttgaaaaaatgaccgacgtgacggtttacagctttatgatgcccattgccggcctgcaccccgatgccgcgcgcaaggcgcaaatcttatggtgtcagcccgaccgcgccaaagcgtggacggattggatgcgtaaaggcaaattcccggtcggcggcagcatctgcgacaatcccgtcgcggaaaccacttccttgggcgaacaattcggcttcaacggcacgccgaccctcgtcttccccaacgggcgcagccaaagcggctacagcccgatgccccaactggaggaaatcatccgcaaaaatcaataa

SEQ ID NO: 40053 - protein, 260 aa, Neisseria meningitidis
MKTKLIKILTPFTVLPLLACGQTPVSNANAEPAVKAESAGKSVAASLKARLEKTYSAQDLKVLSVSETPVKGIYEVVVSGRQIIYTDAEGGYMFVGELINIDTRKNLTEERAADLNKIDFASLPLDKAIKEVRGNGKLKVAVFSDPDCPFCKRLEHEFEKMTDVTVYSFMMPIAGLHPDAARKAQILWCQPDRAKAWTDWMRKGKFPVGGSICDNPVAETTSLGEQFGFNGTPTLVFPNGRSQSGYSPMPQLEEIIRKNQ

SEQ ID NO: 40054 - DNA, 783 bp, Neisseria meningitidis; identical to SEQ ID NO: 40052

SEQ ID NO: 40055 - protein, 260 aa, Neisseria meningitidis; identical to SEQ ID NO: 40053

SEQ ID NO: 40056 - DNA, 619 bp, Neisseria gonorrhoeae
atgcgtattacctgtgcgccgatgtcgcttttgtcggcggcagtctggtcggttcgggctgtcagaacatcatcgaaccgctttcctgcggcgttacgacgatattcggcttttcgacctacaatttttccgaagcctgccggcacgccttggcatcgggtgcggcggttcaagtcgaatcggcggacgcgtggcgtgaagccgttgaaaaaaccttatctggcgaggggggcggaatgcagatgcaggcgcgcgtggacggctttatcgcacaacatcgcggagcgggcgcgagaatcgccgaggcggtgcgggaagcggtatgcggacatcgggggcgatagtgatacaatccgtatccgagttttccggttggagcatcgtatgagtatttatgccgtcgcgcacatcatccacctgtattgcgccaccgcctttgtcggcggcgtgttttttgaagtgctggttttgtccgtcctgcatacgggacgggtgtcgcgcgaggcgcggcgcgaagtggaaaaggcaatgtcttaccgcgccgtcagggtgatgccgtttgcggtcggactgctgttcgccaggggaactctagagtcgactgcagcagcatgccctc

SEQ ID NO: 40057 - protein, 206 aa, Neisseria gonorrhoeae
MRITCAPMSLLSAAVWSVRAVRTSSNRFPAALRRYSAFRPTIFPKPAGTPWHRVRRFKSNRRTRGVKPLKKPYLARGAECRCRRAWTALSHNIAERARESPRRCGKRYADIGGDSDTIRIRVFRLEHRMSIYAVAHIIHLYCATAFVGGVFFEVLVLSVLHTGRVSREARREVEKAMSYRAVRVMPFAVGLLFARGTLESTAAACP

SEQ ID NO: 40058 - DNA, 834 bp, Neisseria meningitidis
atgcgtattacctgtgcgccgatgtcgcttttgtcggcggcagtctggtcgattcgggttgtcagaacatcatcgaaccgctttcctgcggcgttccgacgatattcggcttttcaacctacaatttttccgaagcctgccgacacgccttggcatcgggtgcggcggttcaagtcgaatcggcggatgcgtggcgggaagccgttgaaaaaaccttatcgtccgaggggggggggatgcagatgcaggcgcgcgtggacggctttatcgcacaacatcgcggagcgggcgcgagaatcgccgaggcggtgcgggaagcggtatgcggatatcgggggcgatagtgatacaatccgtatccgagttttccgtttggagcatcgtatgagtatttatgccgtcgcgcacatcgttcatctgtattgcgctattgcctttgtcggcggcgtgttttttgaagtgctggttttgtccgtcctgcatacgggacgggtgtcgcgcgaggcgcggcgcgaagtggaaaaggcaatgtcttaccgcgccgtcagggtgatgccgtttgtggtcggactgctgttcgccagcggcatcgtgatggcggcaaaccgctatctttctatattgggcgaaccgtttgccacttccttcggtacgatgctgacgctgaaaatcctgttggcgttcagcgtattggcgcacttcgccatcgccgtcgtcaaaatggcgcgttccacactgacggtcggttggtcgaaatacatacacgccgtcgtctttacccatatgctgctgattgtctttttggcaaaagcgatgttttatatcagctggtaa

SEQ ID NO: 40059 - protein, 277 aa, Neisseria meningitidis
MRITCAPMSLLSAAVWSIRVVRTSSNRFPAAFRRYSAFQPTIFPKPADTPWHRVRRFKSNRRMRGGKPLKKPYRPRGGGCRCRRAWTALSHNIAERARESPRRCGKRYADIGGDSDTIRIRVFRLEHRMSIYAVAHIVHLYCAIAFVGGVFFEVLVLSVLHTGRVSREARREVEKAMSYRAVRVMPFVVGLLFASGIVMAANRYLSILGEPFATSFGTMLTLKILLAFSVLAHFAIAVVKMARSTLTVGWSKYIHAVVFTHMLLIVFLAKAMFYISW

SEQ ID NO: 40060 - DNA, 834 bp, Neisseria meningitidis
atgcgtattacctgtgcgccgatgtcgcttttgtcggcggcagtctggtcgattcgggctgtcagaacatcatcgaaccgctttcctgcggcgttccgacgatattcggcttttcgacctacaatttttccgaagcctgccggcacgccttggcatcgggtgcggcggttcaagtcgaatcggcggacgcgtggcgggaagccgttgaaaaaaacttatcgtccgaggagggcggaatgcagatgcaggcgcgcgcggacggctttatcgcacaacatcgcggagcgggcgcgagaatcgccgaggcggtacgggaagcggtatgcggacatcggggacgatagtgatacaatccgtatccgagttttccggttggagtaccgtatgagtatttatgccgtcgcgcacatcgtccacctgtattgcgccatcgcctttgtcggcggcgtgttttttgaagtgctggttttgtccgtcctgcatacgggacgggtgtcgtgcgaggcgcggcgcgaagtggaaaaggcaatgtcttaccgcgccgtcagggtgatgccgtttgtggtcggactgctgttcgccagcggcatcgtgatggcggcaaaccgctatctttctatattgggcgaaccgtttgccacttccttcggtacgatgctgacgctgaaaatcctgttggcgttcagcgtgttggcgcacttcgccatcgccgtcgtcaaaatggcgcgttccacactgaccgtcggctggtcgaaatacatacacaccgtcgtctttacccatatgctgctgattgtctttttggcaaaagcgatgttttatatcagctggtaa

SEQ ID NO: 40061 - protein, 277 aa, Neisseria meningitidis
MRITCAPMSLLSAAVWSIRAVRTSSNRFPAAFRRYSAFRPTIFPKPAGTPWHRVRRFKSNRRTRGGKPLKKTYRPRRAECRCRRARTALSHNIAERARESPRRYGKRYADIGDDSDTIRIRVFRLEYRMSIYAVAHIVHLYCAIAFVGGVFFEVLVLSVLHTGRVSCEARREVEKAMSYRAVRVMPFVVGLLFASGIVMAANRYLSILGEPFATSFGTMLTLKILLAFSVLAHFAIAVVKMARSTLTVGWSKYIHTVVFTHMLLIVFLAKAMFYISW

SEQ ID NO: 40062 - DNA, 885 bp, Neisseria gonorrhoeae
atgctcgggatggcgcggcacgacggccagcagggcatcgccgcgatattgttgccacgccgccagcagtttttccgcctcgtcttcgccccgataaacgcgcgtgctgccgcacacggcaaccggccggcctccgatgcgtttttcaaactgccccgccagcgttttcatgtcttcagacggcatcaggtcgtatttggtattgccgcacacctgcacggatgccgcgcccaatttcgccaaccgcgccgcatccgcctccgtctgcgccagacagcccgtcagcgaagcggctgcgggacggatcaggcggcggactttcagataaccgttcagcgatttttccgacagccgcgcattcgccaaaaacagcggcacacccgctcgccggcattccttcatcagattgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgtcccgtcggggtcatctgcgtcatcagcagcggcgcatcgggaaaacgccgccgcaactcgcgtatcaagggctgggcggcacgcgtttctccgaccgaaacggcgtgtatccaaaccgcgccggtaacgggattcggatgcggcttgccgaaacgctcgtccctatgcgcccggtatgccggggcacttccggagcgtttgtccaaataacgccgtatccatatcggcgcaagcagccacaatacatcataaagccattggaacatctttctatttcctgcaaaacaaatgccgtccgaacggttcggacggcatttcggcaacggaatcaaatatcgtag

SEQ ID NO: 40063 - protein, 294 aa, Neisseria gonorrhoeae
MLGMARHDGQQGIAAILLPRRQQFFRLVFAPINARAAAHGNRPASDAFFKLPRQRFHVFRRHQVVFGIAAHLHGCRAQFRQPRRIRLRLRQTARQRSGCGTDQAADFQITVQRFFRQPRIRQKQRHTRSPAFLHQIGPDFGFHQNAEHRAVFAQKLPYPRFFVIRKIAALRIGKQNLRGFPSRRGHLRHQQRRIGKTPPQLAYQGLGGTRFSDRNGVYPNRAGNGIRMRLAETLVPMRPVCRGTSGAFVQITPYPYRRKQPQYIIKPLEHLSISCKTNAVRTVRTAFRQRNQIS

SEQ ID NO: 40064 - DNA, 885 bp, Neisseria meningitidis
atgctcgggatggcgcggcacgacgaccagcagcgcatcgccgcgatattgttgccacgccgccagcagtttttccgcctcgtcttcaccccgataaacgcgcgtgctgccgcacacggcaaccggccggcctccgatgcgtttttcaaactgccccgccagcgttttcatctgttccgacggtatgatgtcgtatttggtattgccgcacacctgcacggatgccgcgcccaatttcgccaaccgcgccgcatccgcctctgtctgcgccagacaccccgtcagcgaagcggcggcaggacggatcaggcggcggactttcagataaccgttcaacgatttttccgacagccgcgcattcgccaaaaacagcggcacacccgcgcgccggcattccctcatcaggttgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgccccgtcggggtcatctgcgtcatcagcagcggcgcatcgggaaaacgccgccgcaactcgcgtatcaaggactgggcggcacgcgtttctccgaccgaaacggcgtgtatccaaaccgcgccggtaacgggattcggatacggcttgccgaaacgctcgtcccgatgcgcccgatatgccggggcacttccggagcgtttgtccaaataacgccgtatccatatcggcgcaagcagccacaatacatcataaagccattggaacatctttctatttcctgcaaaacaaatgccgtctgaacggttcagacggcatttcggcaacggaatcaaatatcgtag

SEQ ID NO: 40065 - protein, 294 aa, Neisseria meningitidis
  misc_feature (281)..(281): Xaa can be any naturally occurring amino acid
MLGMARHDDQQRIAAILLPRRQQFFRLVFTPINARAAAHGNRPASDAFFKLPRQRFHLFRRYDVVFGIAAHLHGCRAQFRQPRRIRLCLRQTPRQRSGGRTDQAADFQITVQRFFRQPRIRQKQRHTRAPAFPHQVGPDFGFHQNAEHRAVFAQKLPYPRFFVIRKIAALRIGKQNLRGFPPRRGHLRHQQRRIGKTPPQLAYQGLGGTRFSDRNGVYPNRAGNGIRIRLAETLVPMRPICRGTSGAFVQITPYPYRRKQPQYIIKPLEHLSISCKTNAVXTVQTAFRQRNQIS

SEQ ID NO: 40066 - DNA, 885 bp, Neisseria meningitidis
atgctcgggatggcgcggcacgacgaccagcagggcatcgccgcgatattgttgccacgccgccagcagtttttccgcctcgtcttcaccccgataaacgcgcgtgctgccgcacacggcaacctgccggtctccgatgcgtttttcaaactgccccgccagcgttttcatctgttccgacggcatcaggtcgtatttggtattgccgcacacctgcacggatgccgcgcccaatttcgccaaccgcgccgcatccgcctccgtctgtgccagacagcccgtcagcgaagcggcggcaggacggatcaggctgcggactttcagataaccgtttagcgatttttccgacagccgcgcattcgccaaaaacagcggcacacccgtgcgccggcattccttcatcagattgggccagatttcggtttccatcaaaatgccgaacatcgggcggtgttcgcgcaaaaactgccgtacccacgtttttttgtcatacggaagatagcggcattgtgcatcaggaaacagaacttgcgcggtttcccgtcccgtcggggtcatctgcgtcatcagcagcggcgcatcgggaaaacgctgccgcaactcgcgtatcaaaggttgggcggcacgcgtttccccgaccgaaacggcgtgtatccaaaccgcgccggtaacgggattcggatacggcttgccgaaacgctcgccccgatgcgcccgatatgcaggggcacttccggagcgtttgtccaaataacgccgtatccatatcggcgcaagcagccacaatacatcataaagccattggaacatctttctatttcctgcaaaacaaatgccgtccgaacggttcggacggcatttcggcaacggaatcaaatatcgtag

SEQ ID NO: 40067 - protein, 293 aa, Neisseria meningitidis
MLGMARHDDQQGIAAILLPRRQQFFRLVFTPINARAAAHGNLPVSDAFFKLPRQRFHLFRRHQVVFGIAAHLHGCRAQFRQPRRIRLRLCQTARQRSGGRTDQAADFQITVRFFRQPRIRQKQRHTRAPAFLHQIGPDFGFHQNAEHRAVFAQKLPYPRFFVIRKIAALCIRKQNLRGFPSRRGHLRHQQRRIGKTLPQLAYQRLGGTRFPDRNGVYPNRAGNGIRIRLAETLAPMRPICRGTSGAFVQITPYPYRRKQPQYIIKPLEHLSISCKTNAVRTVRTAFRQRNQIS

SEQ ID NO: 40068 - DNA, 1293 bp, Neisseria gonorrhoeae
atggctgtcttcccactttcggcaaaacatcggaaatacgcgctgcgcgcgcttgccgtttcgattattctggtgtcggcggcatacattgcttcgacagaggggaccgagcgcgtcagaccgcagcgcgtggaacaaaaactgccgccgctgtcttggggcggcaacggcgttcagacggcatattgggtgcaggaggcggtgcagccgggggactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcagtgcgcgcgaagtgcagttttttaccgacgaagacggcgagcgcaatctggtcgctttggaaaaaaaaggcggcatatggcggcggtcggcttctgatgcggatatgaaggttttgccgacactgcgttcggtcgtggtcaaaacgtcggcgcgcggttcgctggcgcgggcggaagtgcccgtcgaaatccgcgaatccttaagcgggatttttgccggccgcttcagccttgacggtttgaaggaaggcgatgccgtgcgcctgctttacgacagcctgtatttccacgggcagcaggtggcggcgggcgatattttggcggcggaagttgtcaagggcggcacaacccatcaggcgttctattaccgttcggacaaggaaggcggagggggcggcaattattacgatgaagacggcagggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcacaaggcaatgtgcgcggcggcgaggtcatcggttttgtcggttcgacagggcgttcgaccgggccgcacctgcattacgaggcgcgcatcaacgggcagcccgtcaatcctgtttcggtcgcattgccgacacccgaattgacgcaggcggacaaggcggcgtttgccgcgcagaaacagaaggcggacgcgctgcttgcgcgcttgcgcggcataccggttaccgtgtcgcaatcggattga

SEQ ID NO: 40069 - protein, 380 aa, Neisseria gonorrhoeae
LSWGGNGVQTAYWVQEAVQPGDSLADVLARSGMARDEIARITEKYGGEADLRHLRADQSVHVLVGGDGSAREVQFFTDEDGERNLVALEKKGGIWRRSASDADMKVLPTLRSVVVKTSARGSLARAEVPVEIRESLSGIFAGRFSLDGLKEGDAVRLLYDSLYFHGQQVAAGDILAAEVVKGGTTHQAFYYRSDKEGGGGGNYYDEDGRVLQEKGGFNIEPLVYTRISSPFGYRMHPILHTWRLHTGIDYAAPQGTPVRASADGVITFKGRKGGYGNAVMIRHANGVETLYAHLSAFSQAQGNVRGGEVIGFVGSTGRSTGPHLHYEARINGQPVNPVSVALPTPELTQADKAAFAAQKQKADALLARLRGIPVTVSQSD

SEQ ID NO: 40070 - DNA, 1293 bp, Neisseria meningitidis
atggctgtcttcccactttcggcaaaacatcggaaatacgcgctgcgtgcgcttgccgtttcgattattttggtgtcggcggcatacattgcttcgacagagaggacggagcgcgtcagaccgcagcgcgtggaacaaaatctgccgccgctgtcttggggcggcagcggcgttcagacggcatattgggtgcaggaggcggtgcagccgggcgactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaagaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaatccgcgaatccttaagcgggattttcgccggccgcttcagccttgacggtttgaaggaaggcgatgccgtgcgcctgatgtacgacagcctgtatttccacgggcagcaggtggcggcgggcgatattttggcggctgaagtcgttaagggcggcacaaggcatcaggcgttctattaccgttcggacaaggaaggcggagggggcggcaattattatgatgaagacggcaaggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattga

SEQ ID NO: 40071 - protein, 430 aa, Neisseria meningitidis
MAVFPLSAKHRKYALRALAVSIILVSAAYIASTERTERVRPQRVEQNLPPLSWGGSGVQTAYWVQEAVQPGDSLADVLARSGMARDEIARITEKYGGEADLRHLRADQSVHVLVGGDGGAREVQFFTDEDGERNLVALEKKGGIWRRSASEADMKVLPTLRSVVVKTSARGSLARAEVPVEIRESLSGIFAGRFSLDGLKEGDAVRLMYDSLYFHGQQVAAGDILAAEVVKGGTRHQAFYYRSDKEGGGGGNYYDEDGKVLQEKGGFNIEPLVYTRISSPFGYRMHPILHTWRLHTGIDYAAPQGTPVRASADGVITFKGRKGGYGNAVMIRHANGVETLYAHLSAFSQAEGNVRGGEVIGFVGSTGRSTGPHLHYEARINGQPVNPVSVALPTPELTQADKAAFAAQKQKADALLARLRGIPVTVSQSD

SEQ ID NO: 40072 - DNA, 1293 bp, Neisseria meningitidis
atggctgtcttcccactttcggcaaaacatcggaaatacgcgctgcgcgcgcttgccgtttcgattattttggtgtcggcggcatacattgcttcgacagagaggacggagcgcgtcagaccgcagcgcgtggaacaaaaactgccgccgctgtcttggggcggcagcggtgttcagacggcatattgggtgcaggaggcggtgcagccaggcgactcgctggcggacgtgctggcgcgttcgggtatggcgcgggacgaaattgcccgaataacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaaaaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaattcgcgaatccttaagcgggattttcgccggccgcttcagccttgatggtttgaaggaaggcgatgccgtgcgcctgatttacgacagcctgtatttccacgggcagcaggtggcggcgggcgatattctggcggcggaagtcgttaagggcggcacaaggcatcaggcgttctattaccgttcggacaaggaaggaggagggggcggcaattattacgatgaagacggcagggtgttgcaggaaaaaggcggcttcaacatcgagccactggtctatacgcgcatttcttcgccgttcggctaccgtatgcaccccatcctgcacacttggcggctgcacacgggcatcgattatgccgcaccgcagggaacgccggtcagggcttccgccgacggcgtgattacctttaaaggccggaagggtggctacggcaacgcggtgatgatacgccacgccaacggtgtggaaacgctgtatgcgcacttgagcgcgttttctcaggcagaaggcaatgtgcgcggcggcgaggtcatcggttttgtcggttcgaccgggcgttcgacggggccgcacctgcattacgaggcgcgcatcaatgggcagcccgtcaatcctgtttcggtcgcattgccgacacccgaattgacgcaggcggacaaggcggcgtttgccgcgcagaaacagaaggcggacgcgctgcttgcgcgcttgcgcggcataccggttaccgtgtcgcaatcggattga

SEQ ID NO: 40073 - protein, 430 aa, Neisseria meningitidis
MAVFPLSAKHRKYALRALAVSIILVSAAYIASTERTERVRPQRVEQKLPPLSWGGSGVQTAYWVQEAVQPGDSLADVLARSGMARDEIARITEKYGGEADLRHLRADQSVHVLVGGDGGAREVQFFTDEDGERNLVALEKKGGIWRRSASEADMKVLPTLRSVVVKTSARGSLARAEVPVEIRESLSGIFAGRFSLDGLKEGDAVRLIYDSLYFHGQQVAAGDILAAEVVKGGTRHQAFYYRSDKEGGGGGNYYDEDGRVLQEKGGFNIEPLVYTRISSPFGYRMHPILHTWRLHTGIDYAAPQGTPVRASADGVITFKGRKGGYGNAVMIRHANGVETLYAHLSAFSQAEGNVRGGEVIGFVGSTGRSTGPHLHYEARINGQPVNPVSVALPTPELTQADKAAFAAQKQKADALLARLRGIPVTVSQSD

SEQ ID NO: 40074 - DNA, 984 bp, Neisseria gonorrhoeae
atgaaaaactttctttcccttttcgcctccatactgatgtctgccctgattgccgtgtggttcagccaaaaccccatcaacgcctactggcagcagacctaccaccgcaacagcccgctcgaaccgcttgccgcctacggatggtggcggagcggagcggcgttgcaagaaaacgcctacgccctttcagacggcatcaaaaccttcctgtccggcgaaacgccccccacggctcaagacggcggttcggcagatatgccgcctgaagccgccgcatccgaagccgccccgccggccggcggaacagaatggaaacaaggcaccgaagccgccgccgtccgcagcggcgacaaagtctttttcgccggagattcgctgatgcagggcgttgcgcctttcgtgcaaaaaagcctgaaacagcaatacggcatcgaatccgccaacctcagcaaacaaagcacggggctttcctatccctcattcttcgactggccgaaaacgattgaagaaaccttgaaaaaacatcccgaaatcagcgtactcgccgtcttcctcggcccgaacgacccgtgggatttccccgtcggcaaacgctacctcaaattcgcttccgacgaatgggcgcaagaatacctgaaacgcgtcgaccgcatccttgaagccgcacacacgcaccgcgtccaagtcgtctggctcggcatcccctacatgaaaaaagtcaagctcgacggtcagatgcgctacctcgacaaactgctttcggaacacttgaaaggcaaaatcatcctgattcccaccgcgcaaacactgagcggcgggaaaggccgctacaccgattccgtcaacgtcaacggcaaacccgtccgctaccgcagtaaggacggcatacactttaccgccgaaggacaaaaactgctggcggaaaaaataatggaaaaaatcgtttttgaaccgagtacgcaaccatcaagtacacagccatga

SEQ ID NO: 40075 - protein, 327 aa, Neisseria gonorrhoeae
MKNFLSLFASILMSALIAVWFSQNPINAYWQQTYHRNSPLEPLAAYGWWRSGAALQENAYALSDGIKTFLSGETPPTAQDGGSADMPPEAAASEAAPPAGGTEWKQGTEAAAVRSGDKVFFAGDSLMQGVAPFVQKSLKQQYGIESANLSKQSTGLSYPSFFDWPKTIEETLKKHPEISVLAVFLGPNDPWDFPVGKRYLKFASDEWAQEYLKRVDRILEAAHTHRVQVVWLGIPYMKKVKLDGQMRYLDKLLSEHLKGKIILIPTAQTLSGGKGRYTDSVNVNGKPVRYRSKDGIHFTAEGQKLLAEKIMEKIVFEPSTQPSSTQP

SEQ ID NO: 40076 - DNA, 984 bp, Neisseria meningitidis
atgaaaaactttctttcccttttctcctccatactgatgtctgccctgattgccgtgtggttcagccaaaaccccatcaacgcctactggcagcagacctaccaccgcaacagcccgctcgaaccgcttgccgcctacggatggtggcggagcggtgcggcgttgcaagaaaacgcctacgccctttcagacggcatcaaagccttcctgtccggcgaaacgccgccgacggctcaagacggcggttcggcagatatgccgtctgaagccgccgcatccgaagccgtccctcaaaccggtgaaacagaatggaaacaagacaccgaagccgccgccgtccgcagcggcgacaaagtcttttttgtcggcgactcgctgatgcagggcgttgcccccttcgtgcaaaaaagcctgaaacagcaatacggcatcgaatccgtcaacctcagcaaacaaagcacggggctgtcctacccctcattcttcgactggccgaaaacgattgaagaaaccctgcaaaaacatcccgaaatcagcgtactcgccgtcttcctcggaccgaacgacccgtgggatttccccgtcggcaaactctatctcaaattcgcttccgacgaatgggcgcaagaatacctgaaacgtgtcgaccgcatccttgaagccgcacacacgcaccgcgtccaagtcgtctggctcggcatcccctacatgaaaaaagccaagctcgacggacagatgcgctacctagacaaactgctttcggaacatttgaaaggcaaaatcatcctgattcccaccacgcacaccctgagcggcgggaaagaccgctacaccgactccgtcaacgtcaacggcaaacccgtccgctaccgcagcaaggacggcatacactttaccgccgaaggacaaaaactgctggcggcaaaaataatggaaaaaatcgtttttgaaccaagtacgcaaccatcaagtacacagccatga

SEQ ID NO: 40077 - protein, 327 aa, Neisseria meningitidis
MKNFLSLFSSILMSALIAVWFSQNPINAYWQQTYHRNSPLEPLAAYGWWRSGAALQENAYALSDGIKAFLSGETPPTAQDGGSADMPSEAAASEAVPQTGETEWKQDTEAAAVRSGDKVFFVGDSLMQGVAPFVQKSLKQQYGIESVNLSKQSTGLSYPSFFDWPKTIEETLQKHPEISVLAVFLGPNDPWDFPVGKLYLKFASDEWAQEYLKRVDRILEAAHTHRVQVVWLGIPYMKKAKLDGQMRYLDKLLSEHLKGKIILIPTTHTLSGGKDRYTDSVNVNGKPVRYRSKDGIHFTAEGQKLLAAKIMEKIVFEPSTQPSSTQP

SEQ ID NO: 40078 - DNA, 984 bp, Neisseria meningitidis
atgaaaaactttctttcccttttcgcctccatactgatgtctgccctgattgccgtgtggttcagccaaaaccccatcaacgcctactggcagcagacctaccaccgcaacagcccgctcgaaccgcttgccgcctacggatggtggcggagcggtgcggcattgcaagaaaacgcctacgccctttcagacggcatcaaagccttcctgtccggcgaaacgccgccgacggctcaagacggcggttcggcagatatgccgtctgaagccgccgcacccgaaaccgcccctcaaactggcgaaacagaatggaaacaaaacaccgaagccgccgccgtccgaacaggggacaaagtctttttcgccggcgactcgctgatgcagggcgttgcacccttcgtgcaaaaaagcctgaaacagcaatacggcatcgaatccgtcaacctcagcaaacaaagcacggggctgtcctacccctcattcttcgactggccgaaaacgattgaagaaaccctgaaaaaacatcccgaaatcagcgtgctcgccgtcttcctcggtccgaacgacccgtgggatttccccgttggcaaacgctacctcaaattcgcttccgacgaatgggcgcaagaatacctgaaacgcgtcgaccgcatccttgaagccgcacacacgcactacgtccaagtcgtctggctcggcatcccctacatgaaaaaagccaagctcgacggacagatgcgctacctagacaaactgctttcggaatatttgaaaggcaaaatcatcctgattcccaccgcgcacaccctgagcggcgggaaagaccgctacaccgactccgtcaacgtcaacggcaaacccgtccgctaccgcagcaaggacggcatacactttaccgccgaaggacaaaaactgctggcggcaaaaataatggaaaaaatcgtttttgaaccaagtacgcaaccatcaagtacacagccatga

SEQ ID NO: 40079 - protein, 327 aa, Neisseria meningitidis
MKNFLSLFASILMSALIAVWFSQNPINAYWQQTYHRNSPLEPLAAYGWWRSGAALQENAYALSDGIKAFLSGETPPTAQDGGSADMPSEAAAPETAPQTGETEWKQNTEAAAVRTGDKVFFAGDSLMQGVAPFVQKSLKQQYGIESVNLSKQSTGLSYPSFFDWPKTIEETLKKHPEISVLAVFLGPNDPWDFPVGKRYLKFASDEWAQEYLKRVDRILEAAHTHYVQVVWLGIPYMKKAKLDGQMRYLDKLLSEYLKGKIILIPTAHTLSGGKDRYTDSVNVNGKPVRYRSKDGIHFTAEGQKLLAAKIMEKIVFEPSTQPSSTQP

SEQ ID NO: 40080 - DNA, 1194 bp, Neisseria gonorrhoeae
atgaaccccaaacacttcatcgcattttccgccctgttcgccgccacgcaggcagaagccctgcccgtcgcctccgtcagccccgacaccgttaccgtttccccgtccgccccctacaccgatacaaacgggctgctgaccgactacggcaacgccgccgcctcgccttggatgaaaaaactccgatccgtcgcacaaggcagcggcgaggccttccgcatcctgcaaatcggcgactcgcataccgccggcgacttctttaccgacgccctgcgcaaacgcctgcaaaaaacatggggcgacggcggcataggctgggtttaccccgccaacgtcaaagggcagcgcatggcggccgtccgtcacagcggcaactggcaaagcttcaccagcaggaacaataccggagatttcccgctcggcggcatcctcgcccaaaccggcagcggcggcggcatgaccctgaccgcgtctgacggcaaaaccggcaaacagcgcgtttccctgtttgccaaaccgctgctcgccgaacaaaccctgaccgtcaacggcaacaccgtctccgccaacggcggcggctggcaggtactggatacgggcgcggcactgcccctggccatacagaccgaaatgccgtgggacatcggcttcatcaacatcgaaaatcccgccggcggcattaccgtttccgcgatgggcatcaacggcgcacaattgacccagtggtcgaaatggcgtgccgaccgtatgaacgaccttgcccaaaccggcgccgatttggttatcctttcctacggcaccaacgaagccttcaacaacaacatcgacattgccgataccgaacaaaaatggctggataccgtccgccaaatccgcgacagcctgcccgccgccggcatcctcatcatcggcgcgcccgaatccctgaaaaacacgctcggcgtatgcggcacgcgccccgtcctcctgaccgaagtccaacagatgcagcggcgcgtcgcccgtcaggggcagacgatgttttggtcttggcaaaacgcaatgggcggcatatgcagcatgaaaaactggctcaaccaaggatgggccgccaaagacggcgtacacttctccgcccaaggctaccggcgcgcggcggaaatgcttgccgacagcctcgaagaactcgtccgcgccgccgcaatcaggcaataa

SEQ ID NO: 40081 - protein, 397 aa, Neisseria gonorrhoeae; identical to SEQ ID NO: 30943

SEQ ID NO: 40082 - DNA, 1194 bp, Neisseria meningitidis
atgaaccccaaacacctcatcgcattttccgccctattcgccgccacgcaggcagaagccctacctgtcgcctccgtcagcctcgacaccgttaccgtttccccgtccgccccctacaccgatacaaacgggctgctgaccgactacggcaacgcctccgcctcgccttggatgaaaaaactccaatccgtcgcacaaggcagcggcgagaccttccgtatcctgcaaatcggcgactcgcataccgccggcgacttctttaccgacagcctgcgcaaacgcctgcaaaaaacttggggcgacggcggcataggctgggtttaccccgccaacgtcaaagggcagcgcatggcggccgtccggcacaacggtaactggcaaagcctcaccagcaggaacaacaccggagacttcccgctcggcggcatcctcgcccacaccggcagcggcggcagcatgaccctgaccgcatcggacggcatagcaagcaagcagcgcgtttccctgtttgccaaacccctgcttgccgaacaaaccctgaccgtcaacggcaacaccgtctccgccaacggcggcggctggcaggtactggatacgggcgcggcactgcccctgaccatacacaccgaaatgccgtgggacatcggcttcatcaacatcgaaaatcccgccggcggcattaccgtttccgcgatgggcatcaacggcgcacaattaacccagtggtcgaaatggcgtgccgaccgtatgaacgacctcgcccaaaccggcgccgatttggttatcctttcctacggcaccaacgaagctttcaacaacaacatcgacattgccgacaccgaacaaaaatggctggataccgtccgccaaatccgcgacagcctgcctgccgccggcatcctcatcatcggcgcacccgaatccctgaaaaacacgctcggcgtatgcggcacacgccccgtccgcctgaccgaagtccaacagatgcagcggcgcgtcgcccgtcaggggcagacgatgttctggtcttggcaaaacgccatgggcggcatatgcagcatgaaaaactggctcaaccaaggatgggccgccaaagacggcgtacacttctccgccaaaggctaccggcgcgcggcggaaatgctcgccgacagcctcgaagaactcgtccgctccgctgcaatcaggcaataa

SEQ ID NO: 40083 - protein, 397 aa, Neisseria meningitidis
MNPKHLIAFSALFAATQAEALPVASVSLDTVTVSPSAPYTDTNGLLTDYGNASASPWMKKLQSVAQGSGETFRILQIGDSHTAGDFFTDSLRKRLQKTWGDGGIGWVYPANVKGQRMAAVRHNGNWQSLTSRNNTGDFPLGGILAHTGSGGSMTLTASDGIASKQRVSLFAKPLLAEQTLTVNGNTVSANGGGWQVLDTGAALPLTIHTEMPWDIGFINIENPAGGITVSAMGINGAQLTQWSKWRADRMNDLAQTGADLVILSYGTNEAFNNNIDIADTEQKWLDTVRQIRDSLPAAGILIIGAPESLKNTLGVCGTRPVRLTEVQQMQRRVARQGQTMFWSWQNAMGGICSMKNWLNQGWAAKDGVHFSAKGYRRAAEMLADSLEELVRSAAIRQ

SEQ ID NO: 40084 - DNA, 1194 bp, Neisseria meningitidis
atgaaccccaaacacctcatcgcattttccgccctattcgccgccacgcaggcagaagccctacctgtcgcctcagtcagcctcgacaccgttaccgtttccccgtccgccccctacaccgatacaaacgggctgctgaccgactacggcaacgcctccgcctcgccttggatgaaaaaactccaatccgtcgcacaaggcagcggcgagaccttccgtatcctgcaaatcggcgactcgcataccgccggcgacttctttaccgacagcctgcgcaaacgcctacaaaaaacttggggcgacggcggcataggctgggtttaccccgccaacgtcaaagggcagcgcatggcggccgtccggcacaacggtaactggcaaagcctcaccagcaggaacaacaccggagacttcccgctcggcggcatcctcgcccacaccggcagcggcggcagcatgaccctgaccgcatcggacggcatagcaagcaagcagcgcgtttccctgtttgccaaacccctgcttgccgaacaaaccctgaccgtcaacggcaacaccgtctccgccaacggcggcggctggcaggtactggatacgggcgcggcactgcccctgaccatacacaccgaaatgccgtgggacatcggcttcatcaacatcgaaaatcccgccggcggcattaccgtttccgcgatgggcatcaacggcgcacaattaacccagtggtcgaaatggcgtgccgaccgtatgaacgaccttgcccaaaccggcgccgatctagtcatccttgcctacggtaccaacgaagccttcggcgacaacatcgacattgccgataccgaacagaaatggctggataccgtccgccaaatccgcgacagcctacctgccgccggcatcctcatcatcggcgcgcccgaatccctgaaaaacacgctcggcgtatgcggcacacgccccgtccgcctgaccgaagtccaacagatgcagcggcgcatcgcccgtcaggggcagacgatgttctggtcttggcaaaacgcgatgggcggcgtttgcagcatgaaaaactggctcaaccacggatgggccgccaaagacggcgtacacttttccgccaaaggctaccaacggtcggcggaaatgctcgccgacagcctcgaagaactcgtccgctccgctgcaatcaggcaataa

SEQ ID NO: 40085 - protein, 397 aa, Neisseria meningitidis
MNPKHLIAFSALFAATQAEALPVASVSLDTVTVSPSAPYTDTNGLLTDYGNASASPWMKKLQSVAQGSGETFRILQIGDSHTAGDFFTDSLRKRLQKTWGDGGIGWVYPANVKGQRMAAVRHNGNWQSLTSRNNTGDFPLGGILAHTGSGGSMTLTASDGIASKQRVSLFAKPLLAEQTLTVNGNTVSANGGGWQVLDTGAALPLTIHTEMPWDIGFINIENPAGGITVSAMGINGAQLTQWSKWRADRMNDLAQTGADLVILAYGTNEAFGDNIDIADTEQKWLDTVRQIRDSLPAAGILIIGAPESLKNTLGVCGTRPVRLTEVQQMQRRIARQGQTMFWSWQNAMGGVCSMKNWLNHGWAAKDGVHFSAKGYQRSAEMLADSLEELVRSAAIRQ

SEQ ID NO: 40086 - DNA, 1602 bp, Neisseria gonorrhoeae
atgcactcaatatatttttttaaggagaagcagatgagtcaaaccgacgcgcgtcgtagcggacgatttttacgcacagtcgaatggctgggcaatatgttgccgcacccggttacgctttttattattttcattgtgttattgctgattgcctctgccgtcggtgcgtatttcggactatccgtccccgatccgcgtcctgttggggcgaaaggacgtgccgatgacggtttgattcacgttgtcagcctgctcgatgccgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatccccacgcaaactcactacttttatggttgtttttacagggattttatccaatacggcttctgaattgggctatgtcgtcctaatccctttgtccgccgtcatctttcattcgctcggccgccatccgcttgccggtttggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggcagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggcaggcgtggtgtttgttgccttatccgccctattggcttggagcatcgtccctgccgacggtattttgcgtcatcctgaaacaggattggttgccggttcgccgtttttaaaatcgattgttgtttttattttcttgttgtttgcgctgccgggcattgtttatggccggataacccgaagtttgcgcggcgaacgggaagtcgttaatgcgatggccgaatcgatgagtactttgggactttatttggtcatcatcttttttgccgcacagtttgtcgcattttttaattggacgaatattgggcaatatattgccgttaaaggggcggtgttcttaaaagaagtcggcttgggcggcagtgtgttgtttatcggttttattttaatttgtgcttttatcaatctgatgataggctccgcctccgcgcaatgggcggtaactgcgccgattttcgtccctatgctgatgttggccggctacgcgccccaagtcattcaagccgcttaccgcatcggtgattccgttaccaatattattacgccgatgatgagttatttcgggctgattatggcgacggtaatcaaatacaaaaaagatgcgggcgtaggcacgctgatttctatgatgttgccgtattccgctttcttcttaattgcatggatcgccttattctgcatttgggtatttgttttgggtctgcccgtcggtcccggcacacccacattctatccggtgccttaa

SEQ ID NO: 40087 - protein, 533 aa, Neisseria gonorrhoeae
MHSIYFFKEKQMSQTDARRSGRFLRTVEWLGNMLPHPVTLFIIFIVLLLIASAVGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAVIFHSLGRHPLAGLAAAFAGVSGGYSANLFLGTIDPLLAGITQQAAQIIHPDYVVGPEANWFFMAASTFVIALIGYFVTEKIVEPQLGPYQSDLSQEEKDIRHSNEITPLEYKGLIWAGVVFVALSALLAWSIVPADGILRHPETGLVAGSPFLKSIVVFIFLLFALPGIVYGRITRSLRGEREVVNAMAESMSTLGLYLVIIFFAAQFVAFFNWTNIGQYIAVKGAVFLKEVGLGGSVLFIGFILICAFINLMIGSASAQWAVTAPIFVPMLMLAGYAPQVIQAAYRIGDSVTNIITPMMSYFGLIMATVIKYKKDAGVGTLISMMLPYSAFFLIAWIALFCIWVFVLGLPVGPGTPTFYPVP

SEQ ID NO: 40088 - DNA, 1581 bp, Neisseria meningitidis
atgcactcaatatatttttttaaggagaagcagatgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgacggtttgatttacattgtcagcctgctcaatgccgacggttttatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatcgccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaagcacaatcgatccgctcttggcatgcatcacccatcaggcggcggtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgycgggcmttgtttatggmcgggtaacccgaagtttgcgcggcgaacaggaagtcgttaatgcgatggccgaatcgatgagtactctggsgctttmtttgswcakcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 40089 - protein, 526 aa, Neisseria meningitidis
  misc_feature (330)..(330): Xaa can be any naturally occurring amino acid
  misc_feature (332)..(332): Xaa can be any naturally occurring amino acid
  misc_feature (359)..(359): Xaa can be any naturally occurring amino acid
  misc_feature (361)..(361): Xaa can be any naturally occurring amino acid
  misc_feature (363)..(364): Xaa can be any naturally occurring amino acid
MHSIYFFKEKQMSQTDTQRDGRFLRTVEWLGNMLPHPVTLFIIFIVLLLIASAVGAYFGLSVPDPRPVGAKGRADDGLIYIVSLLNADGFIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLSTIDPLLACITHQAAVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALXGXVYGRVTRSLRGEQEVVNAMAESMSTLXLXLXXIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 40090 - DNA, 1602 bp, Neisseria meningitidis
atgcactcaatatatttttttaaggagaagcagatgagtcaaaccgatacgcaacgggacggacgatttttacgcacagtcgaatggctgggcaatatgttgccgcacccggttacgctttttattattttcattgtgttattgctgattgcctctgccgccggtgcgtatttcggactatccgtccccgatccgcgccctgttggtgcgaaaggacgtgccgatgacggtttgattcacgttgtcagcctgctcgatgctgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatctccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcgacattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcaattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 40091 - protein, 533 aa, Neisseria meningitidis
MHSIYFFKEKQMSQTDTQRDGRFLRTVEWLGNMLPHPVTLFIIFIVLLLIASAAGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 40092 - DNA, 822 bp, Neisseria gonorrhoeae
atggattttttgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcggttttggcggtagtgtttgaataccggcagcgtttcagcaatgtgttgcatggcgtgggaaaagaccggaaagccaaccgtttcgtcctcaatcttgccattgcttttatacctgccgccgtgatggggctgttgttcgacaaacaaatcaaagagtatctgtttaaccccttgagtgttgcagtcatgctggttttgggcggtttttttattttgtgggtggagaaacgccaaagccgagcagagcctaaaattgccgatgttgatgcattgcgtccgattgatgcgttgatgatcggtgttgcccaagtgtttgcactggttccgggtacgtcccgttcgggcagtacggttatgggcgggatgctttggggaatcgagcggaaaacggcaacggagttttcatttttcttggccgttccgatgatggttgcagcaacggcttatgatgtcctgaaacattaccgatttttcaccctgcatgatgtcggtttgattttgataggctttattgccgcttttgtttccggtttggtagcggttaaagcactgctgaagtttgtttccaagaaaaactatatcccgtttgcctattaccgcattgttttcggcattgtcatcataatattgtggttgtcgggctggataagttgggaatga

SEQ ID NO: 40093 - protein, 273 aa, Neisseria gonorrhoeae
MDFLIVLKALMMGLVEGFTEFLPISSTGHLIVFGNLIGFHSNHKVFEIAIQLGAVLAVVFEYRQRFSNVLHGVGKDRKANRFVLNLAIAFIPAAVMGLLFDKQIKEYLFNPLSVAVMLVLGGFFILWVEKRQSRAEPKIADVDALRPIDALMIGVAQVFALVPGTSRSGSTVMGGMLWGIERKTATEFSFFLAVPMMVAATAYDVLKHYRFFTLHDVGLILIGFIAAFVSGLVAVKALLKFVSKKNYIPFAYYRIVFGIVIIILWLSGWISWE

SEQ ID NO: 40094 - DNA, 734 bp, Neisseria meningitidis
atggattttctgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcagttttggcggtagtgtttgaataccggcaacgtttcagcaatgtgttgcacggcttgggaaaagaccggaaagccaaccgcttcgtccttaatcttgccattgcttttatacctgccgccgtgatggggctgttgttcggcawacaaatcaaagagyatctgtttaaccccttgagtgttgcagtcatgctggttytggrcggtttttytattttgtgggtggagaaacgccaaagccgagcagagcctaaaattgccgatgttgatgcattgcgtccgattgatgccttgatgatcggcgttgcccaagtgtttgcactggttccgggtacgtcccgttcgggcagtacgattatgggcgggatgctttggggcatcgaacggaaaactgcgacagaattctcgtttttcttggctgtgccgatgatggttgccgcaacggcttatgatgtcctgaaacattaccgatttttcaccctgcatgatgtcggtttgattctgataggctttattgctgcctttgtttcaggcttggtagcggtaaaagcgttgctgaggtttgtttcgggtac

SEQ ID NO: 40095 - protein, 244 aa, Neisseria meningitidis
  misc_feature (102)..(102): Xaa can be any naturally occurring amino acid
  misc_feature (107)..(107): Xaa can be any naturally occurring amino acid
  misc_feature (121)..(121): Xaa can be any naturally occurring amino acid
  misc_feature (124)..(124): Xaa can be any naturally occurring amino acid
MDFLIVLKALMMGLVEGFTEFLPISSTGHLIVFGNLIGFHSNHKVFEIAIQLGAVLAVVFEYRQRFSNVLHGLGKDRKANRFVLNLAIAFIPAAVMGLLFGXQIKEXLFNPLSVAVMLVLXGFXILWVEKRQSRAEPKIADVDALRPIDALMIGVAQVFALVPGTSRSGSTIMGGMLWGIERKTATEFSFFLAVPMMVAATAYDVLKHYRFFTLHDVGLILIGFIAAFVSGLVAVKALLRFVSG

SEQ ID NO: 40096 - DNA, 822 bp, Neisseria meningitidis
atggattttctgattgtcctgaaagccctgatgatgggcttggtagaaggttttaccgaatttttaccgatttccagcaccggacatttgattgtgttcggcaatctgattgattttcacagcaatcacaaggtttttgaaattaccatccagctcggtgcggttttggcggtagtgtttgaataccggcagcgtttcagcaatgtgttgcatggcgtgggaaaagaccggaaagccaaccgtttcgtccttaatcttgccattgcttttatacctgccgccgtgatggggctgttgttcggcaaacaaatcaaagagtatctgtttaaccccttgagtgttgcagtcatgctggttttgggcggtttttttattttgtgggtggagaaacgccaaagccgagcagagcctaaaattgtcgatgttgatgcattgcgtccgattgatgcgttgatgatcggcgttgcccaagtgtttgcactggttccaggtacgtcccgttcgggcagtacgattatgggcgggatgctttggggaatcgagcggaaaacggcaacggagttttcatttttcttggccgttccgatgatggttgcagcaacggcttatgatgtcctgaagcattaccggtttttcaccctgcatgatgtcggtttgattttgattggctttgttgctgcctttgtttcaggcttggtggcggtcaaagcgttgctgaggtttgtttccaagaaaaattatattccttttgcctattaccgcattgtttttggtattgccatcattatattgtggctgtcaggctggataagttgggaatga

SEQ ID NO: 40097 - protein, 273 aa, Neisseria meningitidis
MDFLIVLKALMMGLVEGFTEFLPISSTGHLIVFGNLIDFHSNHKVFEITIQLGAVLAVVFEYRQRFSNVLHGVGKDRKANRFVLNLAIAFIPAAVMGLLFGKQIKEYLFNPLSVAVMLVLGGFFILWVEKRQSRAEPKIVDVDALRPIDALMIGVAQVFALVPGTSRSGSTIMGGMLWGIERKTATEFSFFLAVPMMVAATAYDVLKHYRFFTLHDVGLILIGFVAAFVSGLVAVKALLRFVSKKNYIPFAYYRIVFGIAIIILWLSGWISWE

SEQ ID NO: 40098 - DNA, 804 bp, Neisseria gonorrhoeae
atgtttatgaacaaattttcccaatccggaaaaggtctgtccggtttcttcttcggtttgatactggcaacggtcattattgccggtattttgctttatctgaaccagggcggtcaaaatgcgttcaaaatcccggctccgtcgaagcagcctgcagaaacggaaatcctgaaactgaaaaaccagcctaaggaagacatccaacctgaaccggccgatcaaaacgccttgtccgaaccggatgttgcgaaagaggcagagcagtcggatgcggaaaaagctgccgacaagcagcccgttgccgacaaagccgacgaggttgaagaaaaggcgggcgagccggaacgggaagagccggacggacaggcagtgcgcaagaaagcactgactgaagagcgtgaacaaaccgtcagggaaaaagcgcagaagaaagatgccgaaacggttaaaaaaaaagcggtaaaaccgtctaaagaaacagagaaaaaagcttcaaaagaagagaaaaaggcggcgaaagaaaaagttgcacccaaaccgaccccggaacaaatcctcaacagccgcagtatcgaaaaagcgcgtagtgccgctgccaaagaagtgcagaaaatgaaaaactttgggcaaggcggaagccaacgcattatctgcaaatgggcgcgtatgccgaaccccggagcgcggaagggcagcgtgccaaactggcaatcttgggcatatcttccgaagtggtcggctatcaggcgggacataaaacgctttaccgcgtgcaaagcggcaatatgtccgccgatgcggtga

SEQ ID NO: 40099 - protein, 267 aa, Neisseria gonorrhoeae
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKKAVKPSKETEKKASKEEKKAAKEKVAPKPTPEQILNSRSIEKARSAAAKEVQKMKNFGQGGSQRIICKWARMPNPGARKGSVPNWQSWAYLPKWSAIRRDIKRFTACKAAICPPMR

SEQ ID NO: 40100 - DNA, 759 bp, Neisseria meningitidis
ggtttgttcttcggtttgatactggcgacggtcattattgccggtattttgttttatctgaaccagagcggtcaaaatgcgttcaaaatcccggcttcgtcgaagcagcctgcagaaacggaaatcctgaaaccgmawaaccagcytaaggaagacatccaacctgawccggccgatcaaaacgccttgtccgaaccggatgctgcgacagaggcagagcagtcggatgcggaaaawgctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaawacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaaagcgcgcagtgccgccgccaaagaagtgcagaaaatgaaaacgccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtga

SEQ ID NO: 40101 - protein, 252 aa, Neisseria meningitidis
  misc_feature (46)..(46): Xaa can be any naturally occurring amino acid
  misc_feature (49)..(49): Xaa can be any naturally occurring amino acid
  misc_feature (56)..(56): Xaa can be any naturally occurring amino acid
  misc_feature (79)..(79): Xaa can be any naturally occurring amino acid
  misc_feature (137)..(137): Xaa can be any naturally occurring amino acid
GLFFGLILATVIIAGILFYLNQSGQNAFKIPASSKQPAETEILKPXNQXKEDIQPXPADQNALSEPDAATEAEQSDAEXAADKQPVADKADEVEEKAGEPEREEPDGQAVRKKALTEEREQTVREKAQKKDAETVKXQAVKPSKETEKKASKEEKKAAKEKVAPKPTPEQILNSGSIEKARSAAAKEVQKMKTPTRRKQRIICKWARMPTVRARKGSVPNWQSWAYLPRWSVIRRDIKRFTGCKAAICLPMR

SEQ ID NO: 40102 - DNA, 801 bp, Neisseria meningitidis
atgtttatgaacaaattttcccaatccggaaaaggtctgtccggttttttcttcggtttgatactggcgacggtcattattgccggtattttgttttatctgaaccagagcggtcaaaatgcgttcaaaatcccggttccgtcgaagcagcctgcagaaacggaaatcctgaaaccgaaaaaccagcctaaggaagacatccaacctgaaccggccgatcaaaacgccttgtccgaaccggatgctgcgaaagaggcagagcagtcggatgcggaaaaagctgccgacaagcagcccgttgccgacaaagccgacgaggttgaggaaaaggcggacgagccggagcgggaaaagtcggacggacaggcagtgcgcaagaaagcactgacggaagagcgtgaacaaaccgtcggggaaaaagcgcagaagaaagatgccgaaacggttaaaaaacaagcggtaaaaccatctaaagaaacagagaaaaaagcttcaaaagaagagaaaaaggcggagaaggaaaaagttgcacccaaaccgaccccggaacaaatcctcaacagcggcagcatcgaaaaagcgcgcagtgccgctgccaaagaagtgcagaaaatgaaaacgccgacaaggcggaagcaacgcattatctgcaaatgggcgcgtatgccgaccgccggagcgcggaagggcagcgtgccaaactggcaatcttgggcatatcttccaaggtggtcggttatcaggcgggacataaaacgctttaccgggtgcaaagcggcaatatgtctgccgatgcggtga

SEQ ID NO: 40103 - protein, 266 aa, Neisseria meningitidis
MFMNKFSQSGKGLSGFFFGLILATVIIAGILFYLNQSGQNAFKIPVPSKQPAETEILKPKNQPKEDIQPEPADQNALSEPDAAKEAEQSDAEKAADKQPVADKADEVEEKADEPEREKSDGQAVRKKALTEEREQTVGEKAQKKDAETVKKQAVKPSKETEKKASKEEKKAEKEKVAPKPTPEQILNSGSIEKARSAAAKEVQKMKTPTRRKQRIICKWARMPTAGARKGSVPNWQSWAYLPRWSVIRRDIKRFTGCKAAICLPMR

SEQ ID NO: 40104 - DNA, 867 bp, Neisseria gonorrhoeae
atgaaaaccttcttcaaaaccctttcgaccgcgtcactcgcgctcatcctcgcagcctgcggcggtcaaaaagacagcgcgcccgcagcctctgccgccgccccttctgccgataacggcgcggcgaaaaaagaaatcgtcttcggcacgaccgtgggcgacttcggcgatatggtcaaagaacaaatccaagccgagctggagaaaaaaggctacaccgtcaaattggtcgaatttaccgactatgtgcgcccgaatctggcattggcggagggcgagttggacatcaacgtcttccaacacaaaccctatcttgacgatttcaaaaaagaacacaacctggacatcaccgaagccttccaagtgccgaccgcgcctttgggactgtatccgggcaaactgaaatcgctggaagaagtcaaagacggcagcaccgtatccgcgcccaacgacccgtccaacttcgcacgcgccttggtgatgctgaacgaactgggttggatcaaactcaaagacggcatcaatccgctgaccgcatccaaagccgacatcgcggaaaacctgaaaaacatcaaaatcgtcgagcttgaagccgcacaactgccgcgcagccgcgccgacgtggattttgccgtcgtcaacggcaactacgccataagcagcggcatgaagctgaccgaagccctgttccaagagccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaataccctgccgcatggaatgaaggcgcagccaaataa

SEQ ID NO: 40105 - protein, 288 aa, Neisseria gonorrhoeae
MKTFFKTLSTASLALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 40106 - DNA, 117 bp, Neisseria meningitidis
caatggcttaaagacgtaaccgaggcctataactccgacgcgttcaaagcctacgcgcacaaacgcttcgagggctacaaatcccctgccgcatggaatgaaggcgcagccaaataa

SEQ ID NO: 40107 - protein, 38 aa, Neisseria meningitidis
QWLKDVTEAYNSDAFKAYAHKRFEGYKSPAAWNEGAAK

SEQ ID NO: 40108 - DNA, 864 bp, Neisseria meningitidis
  misc_feature (131)..(131): n is a, c, g, or t
  misc_feature (278)..(278): n is a, c, g, or t
  misc_feature (513)..(513): n is a, c, g, or t
  misc_feature (629)..(629): n is a, c, g, or t
  misc_feature (645)..(645): n is a, c, g, or t
atgaaaaccttcttcaaaaccctttccgccgccgcactcgcgctcatcctcgccgcctgcggcggtcaaaaagatagcgcgcccgccgcatccgcttctgccgccgccgacaacggcgcggcgaaaaaagnaatcgtcttcggcacgaccgtcggcgacttcggcgatatggtcaaagaacaaatccaacccgagctggagaaaaaaggctacaccgtcaaactggtcgagtttaccgactatgtgcgcccgaatctggcattggctgagggcgagtnggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaaganggcatcaatccgctgaccgcatccaaagcggacattgccgaaaacctgaaaaacatcaaaatcgtcgagcttgaagccgcgcaactgccgcgtagccgcgccgacgtggattttgncgtcgtcaacggcaantacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 40109 - protein, 287 aa, Neisseria meningitidis
  misc_feature (44)..(44): Xaa can be any naturally occurring amino acid
  misc_feature (93)..(93): Xaa can be any naturally occurring amino acid
  misc_feature (171)..(171): Xaa can be any naturally occurring amino acid
  misc_feature (210)..(210): Xaa can be any naturally occurring amino acid
  misc_feature (215)..(215): Xaa can be any naturally occurring amino acid
MKTFFKTLSAAALALILAACGGQKDSAPAASASAAADNGAAKKXIVFGTTVGDFGDMVKEQIQPELEKKGYTVKLVEFTDYVRPNLALAEGEXDINVFQHKPYLDDFKKEHNLDITEVFQVPTAPLGLYPGKLKSLEEVKDGSTVSAPNDPSNFARVLVMLDELGWIKLKXGINPLTASKADIAENLKNIKIVELEAAQLPRSRADVDFXVVNGXYAISSGMKLTEALFQEPSFAYVNWSAVKTADKDSQWLKDVTEAYNSDAFKAYAHKRFEGYKSPAAWNEGAAK

SEQ ID NO: 40110 - DNA, 699 bp, Neisseria gonorrhoeae
atgttaaatcgggtattttatcggatattgggtgttgccgacaatttgtatccgtgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggcgcggagatggcgcgcgcttcggaaacggattatacgaaagacgaagtatatgccttggctgatttcgtccatccgatcggcaatatcggggcgtgcattgccagcggtacgtttaaaacggacgggatgctggtcgcaccctgttcgatgcggacgcttgcctctgtcgcgcacggcttcggcgacaacctcttgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaagccgcagacggcggacgacatagtggcgcacagtatcgcacacacgctgtcgctgttcggaatcgatacgccggatttggcggaatggcagggaatggcggattaa

SEQ ID NO: 40111 - protein, 232 aa, Neisseria gonorrhoeae
MLNRVFYRILGVADNLYPCLSDFCFFTIIAGLPLQAVLWERRMMVRRLIIGISGASGFQYGVKALELLRAQDVETHLVVSKGAEMARASETDYTKDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSIAHTLSLFGIDTPDLAEWQGMAD

SEQ ID NO: 40112 - DNA, 693 bp, Neisseria meningitidis
atgttaaatcgggtattttatcggatattgggtgttgccgacaatttgtatccgcgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggtgcggagatggcgcgcgcttcggaaacggcttatgcgagagacgaggtatatgccttggcggacttcgtgcatccgatcggcaatatcggggcgtgcattgccagcggtacgtttaaaacggatgggatgctggtcgccccctgttcgatgcggacgcttgcctctgtcgcgcacggcttcggcgacaatctgctgacgcgtgcggcggatgtggttttgaaggaaaggcggcggctggtgctgatggtgcgcgaaacgccgctgaaccttgcccatttggacaatatgaagcgggwaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcarggaatggcg

SEQ ID NO: 40113 - protein, 231 aa, Neisseria meningitidis
  misc_feature (181)..(181): Xaa can be any naturally occurring amino acid
MLNRVFYRILGVADNLYPRLSDFCFFTIIAGLPLQAVLWERRMMVRRLIIGISGASGFQYGVKALELLRAQDVETHLVVSKGAEMARASETAYARDEVYALADFVHPIGNIGACIASGTFKTDGMLVAPCSMRTLASVAHGFGDNLLTRAADVVLKERRRLVLMVRETPLNLAHLDNMKRXTEMGGVVFPPVPAMYRKPQTADDIVAHSVAHALSLFGIDTPDSAEWQGMA

SEQ ID NO: 40114 - DNA, 699 bp, Neisseria meningitidis
  misc_feature (198)..(198): n is a, c, g, or t
  misc_feature (275)..(275): n is a, c, g, or t
  misc_feature (291)..(291): n is a, c, g, or t
  misc_feature (312)..(312): n is a, c, g, or t
  misc_feature (537)..(537): n is a, c, g, or t
atgttaaatcggatattttatcggatattgggtgttgccgacaatttgtatccgtatttatcggatttctgttttttcactataatagccggtttgccgttgcaggcggttttatgggaaaggcggatgatggtacggcgtttgataatcggcatcagtggggcgagcggtttccaatacggcgtgaaggctttggancttttacgcgcgcaagatatcgaaacgcaccttgtggtatcgaaaggtgcggagatggcgcgcgcttcggaaacggnttatgcgagagacgangtatatgccttggcggacttngtgcatccgatcggcaatatcggggcgtgcattgccagcggtacgtttaaaacggacgggatgctggtcgccccctgttcgatgcggacgcttgcctcggtcgtgcacggcttcggcgacaacctcttgacgcgtgcggcggatgtggttttgaaggaaaggcggcggctggtgctgatggtgcgcgaaacgccgctgaaccttgcccatttggacaatatgaancgggtaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcagggaatggcggattaa

SEQ ID NO: 40115 - protein, 232 aa, Neisseria meningitidis
  misc_feature (66)..(66): Xaa can be any naturally occurring amino acid
  misc_feature (92)..(92): Xaa can be any naturally occurring amino acid
  misc_feature (97)..(97): Xaa can be any naturally occurring amino acid
  misc_feature (104)..(104): Xaa can be any naturally occurring amino acid
  misc_feature (179)..(179): Xaa can be any naturally occurring amino acid
MLNRIFYRILGVADNLYPYLSDFCFFTIIAGLPLQAVLWERRMMVRRLIIGISGASGFQYGVKALXLLRAQDIETHLVVSKGAEMARASETXYARDXVYALADXVHPIGNIGACIASGTFKTDGMLVAPCSMRTLASVVHGFGDNLLTRAADVVLKERRRLVLMVRETPLNLAHLDNMXRVTEMGGVVFPPVPAMYRKPQTADDIVAHSVAHALSLFGIDTPDSAEWQGMAD

SEQ ID NO: 40116 - DNA, 699 bp, Neisseria gonorrhoeae; identical to SEQ ID NO: 40110

SEQ ID NO: 40117 - protein, 232 aa, Neisseria gonorrhoeae; identical to SEQ ID NO: 40111

SEQ ID NO: 40118 - DNA, 699 bp, Neisseria meningitidis
atgttaaatcgggtattttatcggatattgggtgttgccgacaatttgtatccgcgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggtgcggagatggcgcgcgcttcggaaacggcttatgcgagagacgaggtatatgccttggcggacttcgtgcatccgatcggcaatatcggggcgtgcattgccagcggtacgtttaaaacggatgggatgctggtcgccccctgttcgatgcggacgcttgcctctgtcgcgcacggcttcggcgacaatctgctgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcagggaatggcggattaa

SEQ ID NO: 40119 - protein, 232 aa, Neisseria meningitidis
MLNRVFYRILGVADNLYPRLSDFCFFTIIAGLPLQAVLWERRMMVRRLIIGISGASGFQYGVKALELLRAQDVETHLVVSKGAEMARASETAYARDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSVAHALSLFGIDTPDSAEWQGMAD

SEQ ID NO: 40120 - DNA, 699 bp, Neisseria meningitidis; identical to SEQ ID NO: 40114
  misc_feature (198)..(198): n is a, c, g, or t
  misc_feature (275)..(275): n is a, c, g, or t
  misc_feature (291)..(291): n is a, c, g, or t
  misc_feature (312)..(312): n is a, c, g, or t
  misc_feature (537)..(537): n is a, c, g, or t

SEQ ID NO: 40121 - protein, 232 aa, Neisseria meningitidis; identical to SEQ ID NO: 40115
  misc_feature (66)..(66): Xaa can be any naturally occurring amino acid
  misc_feature (92)..(92): Xaa can be any naturally occurring amino acid
  misc_feature (97)..(97): Xaa can be any naturally occurring amino acid
  misc_feature (104)..(104): Xaa can be any naturally occurring amino acid
  misc_feature (179)..(179): Xaa can be any naturally occurring amino acid

SEQ ID NO: 40122 - DNA, 1368 bp, Neisseria gonorrhoeae
atgttcagtttcggctgggcgtttgaccgcccgcagtatgagttgggttcgctgtcgcctgttgcggcacttgcgtgccggcgcgctttggggtgtttgggtttggaaacgcaaatcaagtggccaaacgatttggtcgtcggacgcgacaaattgggcggcattctgattgaaacagtcagggcgggcggtaaaacggttgccgtggtcggtatcggcatcaatttcgtgctgcccaaggaagtggaaaacgccgcttccgtgcagtcgctgtttcagacggcatcgcggcggggcaatgccgatgccgccgtattgctggaaacattgcttgcggaactgggcgcggtgttggaacaatatgcggaagaagggttcgcgccatttttaaatgagtatgaaacggccaaccgcgaccacggcaaggcggtattgctgttgcgcgacggcgaaaccgtgtgcgaaggcacggttaaaggcgtggacggacgaggcgttctgcacttggaaacggcagaaggcgaacagacggtcgtcagcggcgaaatcagcctgcggcccgacaacaggtcggtttccgtgccgaagcggccggattcggaacgttttttgctgttggaaggcgggaacagccggctcaagtgggcgtgggtggaaaacggcacgttcgcaaccgtgggcagcgcgccgtaccgcgatttgtcgcctttgggcgcggagtgggcggaaaaggcggatggaaatgtccgcatcgtcggttgcgccgtgtgcggagaatccaaaaaggcacaagtgaaggaacagctcgcccgaaaaatcgagtggctgccgtcttccgcacaggctttgggcatacgcaaccactaccgccaccccgaagaacacggttccgaccgttggttcaacgccttgggcagccgccgcttcagccgcaacgcctgcgtcgtcgtcagttgcggcacggcggtaacggttgacgcgctcaccgatgacggacattatctcggcggaaccatcatgcccggcttccacctgatgaaagaatcgctcgccgtccgaaccgccaacctcaaccgccccgccggcaaacgttaccctttcccgaccacaacgggcaacgccgtcgcaagcggcatgatggacgcggtttgcggctcgataatgatgatgcacggccgtttgaaagaaaaaaacggcgcgggcaagcctgtcgatgtcatcattaccggcggcggcgcggcgaaagtcgccgaagccctgccgcctgcatttttggcggaaaataccgtgcgcgtggcggacaacctcgtcatccacgggctgctgaacctgattgccgccgaaggcggggaatcggaacacgcttaa

SEQ ID NO: 40123 - protein, 455 aa, Neisseria gonorrhoeae
MFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 40124 - DNA, 1167 bp, Neisseria meningitidis
  misc_feature (240)..(240): n is a, c, g, or t
  misc_feature (321)..(344): n is a, c, g, or t
  misc_feature (367)..(367): n is a, c, g, or t
  misc_feature (385)..(385): n is a, c, g, or t
atgttcagttttggctgggtgtttgaccggccgcagtatgagttgggttcgctgtcgcctgttgcggcagtggcgtgtcggcgcgccttgtcgcgtttaggtttggatgtgcarattaagtggcccaatgatttggttgtcggacgcgacaaattgggcggcattctgattgaaacggtcaggacgggcggcaaaacggttgccgtggtcggtatcggcatcaattttgtcctgcccaangaagtagaaaatgccgcttccgtgcaatcgctgtttcagacggcatcgcggcggggcaatgccgatgccgccgtgctgctnnnnnnnnnnnnnnnnnnnnnnnnggaaatcagcctgcggtccgacnacaggccggtttccgtgncgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgtttggcatacgcaaccactaccgccaccccgaagaacacggttccgaccgctggttcaacgccttgggcagccgccgcttcagccgcaacgcytgcgtcgtcgtcagttgcggcacggcggtaacggttgacgcgctcaccgatgacggacattatctcggrggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacat

SEQ ID NO: 40125 - protein, 389 aa, Neisseria meningitidis
  misc_feature (80)..(80): Xaa can be any naturally occurring amino acid
  misc_feature (108)..(115): Xaa can be any naturally occurring amino acid
  misc_feature (123)..(123): Xaa can be any naturally occurring amino acid
  misc_feature (129)..(129): Xaa can be any naturally occurring amino acid
MFSFGWVFDRPQYELGSLSPVAAVACRRALSRLGLDVQIKWPNDLVVGRDKLGGILIETVRTGGKTVAVVGIGINFVLPXEVENAASVQSLFQTASRRGNADAAVLLXXXXXXXXEISLRSDXRPVSVXKRRDSERFLLLDGGNSRLKWAWVENGTFATVGSAPYRDLSPLGAEWAEKADGNVRIVGCAVCGEFKKAQVQEQLARKIEWLPSSAQALFGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEH

SEQ ID NO: 40126 - DNA, 1368 bp, Neisseria meningitidis
atgttcagttttggctgggtgtttgaccggccgcagtatgagttgggttcgctgtcgcctgttgcggcagtggcgtgccggcgcgccttgtcgcgtttgggtttgaaaacgcaaatcaagtggccaaacgatttggtcgtcggacgcgacaaattgggcggcattctgattgaaacggtcaggacgggcggcaaaacggttgccgtggtcggtatcggcatcaatttcgtgctgcccaaggaagtggaaaacgccgcttccgtgcaatcgctgtttcagacggcatcgcggcggggaaatgccgatgccgccgtgttgctggaaacgctgttggcggaacttgatgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttctgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggtggatggaaatgtccgcatcgtcggttgcgccgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcattcacgggctgctgaacctgattgccgccgaaggcggggaatcggaacatacttaa

SEQ ID NO: 40127 - protein, 455 aa, Neisseria meningitidis
MFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 40128 - DNA, 1779 bp, Neisseria gonorrhoeae
atgacggttttgaagccttcgcattggcgggtgttggcggagcttgccgacggtttgccgcaacacgtatcgcaattggcgcgtgaggcggacatgaagccgcagcagctcaacggtttttggcagcagatgccggcgcatatacgcgggctgttgcgccaacacgacggctattggcggctggtgcgccccttggcggttttcgatgccgaaggtttgcgcgatctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgcctgatgttcagtttcggctgggcgtttgaccggccgcagtatgagttgggttcgctgtcgcctgttgcggcacttgcgtgccggcgcgctttggggtgtttgggtttggaaacgcaaatcaagtggccaaacgatttggtcgtcggacgcgacaaattgggcggcattctgattgaaacagtcagggcgggcggtaaaacggttgccgtggtcggtatcggcatcaatttcgtgctgcccaaggaagtggaaaacgccgcttccgtgcagtcgctgtttcagacggcatcgcggcggggcaatgccgatgccgccgtattgctggaaacattgcttgcggaactgggcgcggtgttggaacaatatgcggaagaagggttcgcgccatttttaaatgagtatgaaacggccaaccgcgaccacggcaaggcggtattgctgttgcgcgacggcgaaaccgtgtgcgaaggcacggttaaaggcgtggacggacgaggcgttctgcacttggaaacggcagaaggcgaacagacggtcgtcagcggcgaaatcagcctgcggcccgacaacaggtcggtttccgtgccgaagcggccggattcggaacgttttttgctgttggaaggcgggaacagccggctcaagtgggcgtgggtggaaaacggcacgttcgcaaccgtgggcagcgcgccgtaccgcgatttgtcgcctttgggcgcggagtgggcggaaaaggcggatggaaatgtccgcatcgtcggttgcgccgtgtgcggagaatccaaaaaggcacaagtgaaggaacagctcgcccgaaaaatcgagtggctgccgtcttccgcacaggctttgggcatacgcaaccactaccgccaccccgaagaacacggttccgaccgttggttcaacgccttgggcagccgccgcttcagccgcaacgcctgcgtcgtcgtcagttgcggcacggcggtaacggttgacgcgctcaccgatgacggacattatctcggcggaaccatcatgcccggcttccacctgatgaaagaatcgctcgccgtccgaaccgccaacctcaaccgccccgccggcaaacgttaccctttcccgaccacaacgggcaacgccgtcgcaagcggcatgatggacgcggtttgcggctcgataatgatgatgcacggccgtttgaaagaaaaaaacggcgcgggcaagcctgtcgatgtcatcattaccggcggcggcgcggcgaaagtcgccgaagccctgccgcctgcatttttggcggaaaataccgtgcgcgtggcggacaacctcgtcatccacgggctgctgaacctgattgccgccgaaggcggggaatcggaacacgcttaa

SEQ ID NO: 40129 - protein, 592 aa, Neisseria gonorrhoeae
MTVLKPSHWRVLAELADGLPQHVSQLAREADMKPQQLNGFWQQMPAHIRGLLRQHDGYWRLVRPLAVFDAEGLRDLGERSGFQTALKHECASSNDEILELARIAPDKAHKTICVTHLQSKGRGRQGRKWSHRLGECLMFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 40130 - DNA, 1779 bp, Neisseria meningitidis
atgacggttttgaagctttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgtcggcgcgccttgtcgcgtttaggtttggatgtgcagattaagtggcccaatgatttggttgtcggacgcgacaaattgggcggcattctgattgaaacggtcaggacgggcggcaaaacggttgccgtggtcggtatcggcatcaattttgtcctgcccaaggaagtagaaaatgccgcttccgtgcaatcgctgtttcagacggcatcgcggcggggcaatgccgatgccgccgtgctgctggaaacgctgttggtggaactggacgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttttgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacatatttaa

SEQ ID NO: 40131 - protein, 592 aa, Neisseria meningitidis
MTVLKLSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLDVQIKWPNDLVVGRDKLGGILIETVRTGGKTVAVVGIGINFVLPKEVENAASVQSLFQTASRRGNADAAVLLETLLVELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKADGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEHI

SEQ ID NO: 40132 - DNA, 1779 bp, Neisseria meningitidis
atgacggttttgaagccttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgtgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgccggcgcgccttgtcgcgtttgggtttgaaaacgcaaatcaagtggccaaacgatttggtcgtcggacgcgacaaattgggcggcattctgattgaaacggtcaggacgggcggcaaaacggttgccgtggtcggtatcggcatcaatttcgtgctgcccaaggaagtggaaaacgccgcttccgtgcaatcgctgtttcagacggcatcgcggcggggaaatgccgatgccgccgtgttgctggaaacgctgttggcggaacttgatgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttctgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggtggatggaaatgtccgcatcgtcggttgcgccgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcattcacgggctgctgaacctgattgccgccgaaggcggggaatcggaacatacttaa

SEQ ID NO: 40133 - protein, 592 aa, Neisseria meningitidis
MTVLKPSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 40134 - DNA, 1356 bp, Neisseria gonorrhoeae
atgagtatccaatccggcgaaattttagaaaccgtcaaaatggttgccgaccggaattttgatgtccgcaccattaccatcggcattgatttgcacgactgcatcagcaccgacatcgacgtgttaaaccaaaacatttacaacaaaatcaccacggtcggcaaagacttggtggcaacggcgaaacacctttccgccaaatacggcgtgccgattgtgaatcagcgcatttccgttacgccgattgcccaaatcgcggcggcgaccaaagccgacagttatgtcagcgtggcgcagactttggacaaggcagccaaagccatcggcgtgtcctttatcggcggcttttccgcgctggtgcaaaaaggtatgtcgccttcggatgaggtgttgatccgttccgttcccgaagcgatgaaaactaccgatatcgtgtgcagctccatcaatatcggcagcacgcgtgccggtatcaatatggatgcggtcaagctggcaggcgaaaccatcaaacgcacggctgaaatcacacccgaaggtttcggctgcgccaaaatcgtcgtgttctgcaacgcggtggaagacaatccgtttatggcgggtgcgttccacggctcgggcgaagcggatgctgtgattaatgtcggcgtatccggtccaggcgtggtcaaagccgcgctggaaaattcggacgcggtcagcctgaccgaggtcgccgaagtcgtgaagaaaaccgctttcaaaatcacccgcgtgggcgaactcatcggtcgcgaagcctcaaaaatgctgaatatcccgttcggcattctcgatttgtcgctggcaccgacccccgccgtcggcgactcggtggcgcgcattcttgaagaaatgggcttgagcgtctgcggtacgcacggcacaacagcagctttggcattgctgaacgatgccgtgaaaaagggcggcatgatggcttccagcgcggtcggcggtttgagcggcgcgtttatccccgtttccgaagacgaaggtatgattgccgccgccgaggcaggcgtgttgacgctggacaaactcgaagccatgaccgccgtctgctccgttggtttggacatgattgccgttcccggcgacacgcccgcgcacaccatttccggcatcatcgccgacgaagccgccatcggcatgatcaacagcaaaaccaccgccgtgcgcattattccggtaacgggcaaaaccgtcggcgacagcgtcgagttcggcggtctgttgggctacgcgcctgtaatgccggcaaaagaaggttcgtgcgaagtgttcgtcaaccggggcggcaggattcccgcaccggttcaatcgatgaaaaactga

SEQ ID NO: 40135 - protein, 451 aa, Neisseria gonorrhoeae
MSIQSGEILETVKMVADRNFDVRTITIGIDLHDCISTDIDVLNQNIYNKITTVGKDLVATAKHLSAKYGVPIVNQRISVTPIAQIAAATKADSYVSVAQTLDKAAKAIGVSFIGGFSALVQKGMSPSDEVLIRSVPEAMKTTDIVCSSINIGSTRAGINMDAVKLAGETIKRTAEITPEGFGCAKIVVFCNAVEDNPFMAGAFHGSGEADAVINVGVSGPGVVKAALENSDAVSLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPAKEGSCEVFVNRGGRIPAPVQSMKN

SEQ ID NO: 40136 - DNA, 1344 bp, Neisseria meningitidis
atgagtatccaatccggcgaaattttagaaaccgtcaaaatggttgccgaccagaattttgatgtccgcaccattaccatcggcattgatttgcacgactgcatcagcagcgatatcaatgtgttgaaccaaaatatttacaataaaattaccacagtcggcaaagacttggtcactacggcaaaatatctgtctgccaaatacggcgtaccgattgtgaatcagcgcatttccgttacgccgattgcccaaatcgcggcggccacccatgctgattcttacgtcagcgtggcgcaaactttggataaagctgccaaagccatcggtgtgtcttttatcggcggtttttccgcgttggtgcaaaaagggatgtcgccttcggatgaggtgttaatccgctccattcccgaagcgatgaagactaccgatattgtgtgcwgctccatcaatatcggcagtacgcgtgccggtatcaatatggatgcggtcaagctggcgggcgaaaccgtcaaacgcacggcggaaatcacgcccgaaggtttcggctgcgctaaaattgtcgtgttctgcaacgcggtggaagacaacccgtttwtggcgggcgcgtttcatggttcgggcgatgccgttatcaatgtcggcgtatccggcccaggtgtcgtaaaagccgcgttggaaaattcagatgcaacgacattgaccgaagttgcggaagtagtgaagaaaactgctttcaaaattacccgcgtgggcgaactcatcggccgcgaagcctcaaaaatgctgaatatcccgtttggtattctcgacttgtcgccgaccccgcccgtcggcgactcagtggcacgcattcttgaagaaatgggcttgagcgtctgcggtacgcacggcacaacagcagctttggcattgctgaacgatgccgtgaaaaaaggcggcatgatggcttccagcgcggtcgggggtttgagtggcgcgtttatccccgtttccgaagacgaaggtatgatygmcgccgccgaagcaggcgtgctgacgctggacaaactcgaagccatgaccgccgtttgttcggtcggcttggatatgattgccgttcccggcgacacgcccgcgcacaccatttccggcatcattgccgacgaagccgccatcggcatgatcaacagcaaaaccactgccgtgcgcattattccggtaaccggtaaaaccgtcggcgacacggtcgagttcggcggcttgttgggctacgcgcctgtgatgccggtcaaagaaggttcgtgcgaagtattcgtcaaccgaggcggcagaattccggctccggttcaatcgatgaaaaactga

SEQ ID NO: 40137 - protein, 447 aa, Neisseria meningitidis
  misc_feature (147)..(147): Xaa can be any naturally occurring amino acid
  misc_feature (199)..(199): Xaa can be any naturally occurring amino acid
  misc_feature (338)..(338): Xaa can be any naturally occurring amino acid
MSIQSGEILETVKMVADQNFDVRTITIGIDLHDCISSDINVLNQNIYNKITTVGKDLVTTAKYLSAKYGVPIVNQRISVTPIAQIAAATHADSYVSVAQTLDKAAKAIGVSFIGGFSALVQKGMSPSDEVLIRSIPEAMKTTDIVCXSINIGSTRAGINMDAVKLAGETVKRTAEITPEGFGCAKIVVFCNAVEDNPFXAGAFHGSGDAVINVGVSGPGVVKAALENSDATTLTEVAEVVKKTAFKITRVGELIGREASKMLNIPFGILDLSPTPPVGDSVARILEEMGLSVCGTHGTTAALALLNDAVKKGGMMASSAVGGLSGAFIPVSEDEGMIXAAEAGVLTLDKLEAMTAVCSVGLDMIAVPGDTPAHTISGIIADEAAIGMINSKTTAVRIIPVTGKTVGDTVEFGGLLGYAPVMPVKEGSCEVFVNRGGRIPAPVQSMKN

SEQ ID NO: 40138 - DNA, 1356 bp, Neisseria meningitidis
atgagtatccaatccggcgaaattttagaaaccgtcaaaatggttgccgaccagaatttcgatgtccgcaccattaccatcggcattgatttgcacgactgcatcagcaccgacatcgacgtgttgaaccaaaatatttacaacaaaattaccacggtcggcaaagacttggtggcgacagcaaaatatctgtctgccaaatacggcgtgccgattgtgaatcagcgcatttctgtcacgccgattgcccaaatcgcggcggccacccatgctgattcttacgtcagcgtggcgcaaactttggataaggctgccaaagccatcggcgtgtcttttattggcggcttttccgcgctggtgcaaaaaggtatgtcgccttctgacgaggtgttaatccgttccattcccgaagcgatgaagactactgatatcgtgtgcagctccatcaatatcggcagtacgcgcgccggtatcaatatggacgcggtcagactggcgggcgaaaccatcaaacgcacggctgaaatcacactagaaggtttcggctgcgccaaaatcgtcgtgttctgcaacgcggtggaagacaacccgtttatggcgggcgcgtttcacggctcaggcgaagcggatgctgtgattaatgtcggcgtatccggcccgggtgtcgtaaaagccgcgttggaaaattcggatgcaacgacattgaccgaagttgccgaagttgtgaagaaaaccgccttcaaaattacccgcgtgggcgaactcatcggccgcgaagcctcaaaaatgctgaatatcccgtttggtattctcgacttgtcgctggcaccgacccctgccgtcggcgactcggtggcgcgcattcttgaagaaatgggtttgagcgtctgcggtacgcacggcacaacagcagctttggcattgctgaacgatgccgtgaaaaagggcggcatgatggcttcgagcgcggttggcggtttgagtggcgcgtttatccccgtttccgaagacgaaggtatgattgccgccgccgaagcaggcgtgctgacgttggataaactcgaagcgatgaccgccgtttgttcggtcggcttggatatgattgccgttcccggcgacacacccgcgcacaccatttccggcatcattgccgacgaagccgccatcggcatgatcaacagcaaaaccactgccgtgcgcattattccggtaaccggtaaaaccgtcggcgacagcgtcgagttcggcggcctgttgggctacgcgcctgtaatgccggtaaaagaaggctcatgcgaagtgttcgtcaaccggggcggcaggattcccgcaccggttcaatcgatgaaaaactga

SEQ ID NO: 40139 - protein, 451 aa, Neisseria meningitidis
MSIQSGEILETVKMVADQNFDVRTITIGIDLHDCISTDIDVLNQNIYNKITTVGKDLVATAKYLSAKYGVPIVNQRISVTPIAQIAAATHADSYVSVAQTLDKAAKAIGVSFIGGFSALVQKGMSPSDEVLIRSIPEAMKTTDIVCSSINIGSTRAGINMDAVRLAGETIKRTAEITLEGFGCAKIVVFCNAVEDNPFMAGAFHGSGEADAVINVGVSGPGVVKAALENSDATTLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPVKEGSCEVFVNRGGRIPAPVQSMKN

SEQ ID NO: 40140 - DNA, 522 bp, Neisseria gonorrhoeae
atggacgacccgcgcacctacggatcgggcaatcccggcgcgaccaatgttttacgcagcggcaaaaaaaaggcggccgcgctgacgctcttgggcgatgccgccaaaggtttggttgccgttttgcttgcacgcgtgcttcaagaaccgctcggtttatccgacagcgcaatcgccgccgtcgcactcgccgcgctggtcgggcatatgtggccggtgtttttcggatttaagggcggcaaaggcgtggcaacggcattgggcgtgcttctggcactctctcctgcaactgccttggtctgcgcgttgatttggcttgtgatggcattcggcttcaaagtatcctcccttgccgcgctggtcgccacaaccgccgccccccttgccgcactgttttttatgccgcatacttcttggattttcgcaaccctcgcaatcgccatattggtgttgctccgccataagagcaacatcctcaacctgattaaaggcaaagaaagcaaaatcggcgaaaaacgctga

SEQ ID NO: 40141 - protein, 173 aa, Neisseria meningitidis
MDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALVATTAAPLAALFFMPHTSWIFATLAIAILVLLRHKSNILNLIKGKESKIGEKR

SEQ ID NO: 40142 - DNA, 522 bp, Neisseria meningitidis
atggacgacccgcgcacctacggatcgggcaatccgggggcaaccaatgttttacgcagcggcaaaaaaaaggcggccgcgctgacgctcttgggcgatgccgccaaaggtttagttgccgttttgcttgcacgcgtgcttcaagaaccgctcggtttatccgacagcgcaatcgcggccgtcgcactcgccgcgctggtcgggcatatgtggccggtgtttttcggatttaaaggcggcaaaggcgtggcaacggcattgggcgtgcttctggcactctctcccgcaactgccttggtctgcgcgttgatttggcttgttatggcattcggcttcaaggtgtcctcccttgccgcattaaccgccacaatcgccgcaccggtcgccgcatccttctttatgccgcacgtctcgtgggtttgggcgaccgtcgccattgctttgctggtgttgttccgccacaaaagtaatatcgtcaagctgctcgaaggcagagaaagcaaaatcggcggcagccgctga

SEQ ID NO: 40143 - protein, 173 aa, Neisseria meningitidis
MDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALTATIAAPVAASFFMPHVSWVWATVAIALLVLFRHKSNIVKLLEGRESKIGGSR

SEQ ID NO: 40144 - DNA, 522 bp, Neisseria meningitidis
atggacgacccgcgcacctacggatcgggcaatccgggggcaaccaatgttttacgcagcggcaaaaaaaaggcggccgcgctgacgctcttgggcgatgccgccaaaggtttggttgccgttttgcttgcacgcgtgcttcaagaaccgctcggtttatccgacagcgcaatcgcggccgtcgcactcgccgcgctggtcgggcatatgtggccggtgtttttcggatttaaaggcggcaaaggcgtggcaacggcattgggcgtgcttctggcactctctcccacaactgccttggtctgcgcgttgatttggcttgtgatggcattcggcttcaaggtgtcctcccttgccgcattaaccgccacaatcgccgccccccttgccgcactgttttttatgccgcatacttcttggattttcgcaaccctcgcaatcgccatattggtgttgctccgccataagagcaacatcctcaacctgattaaaggcaaagaaagcaaaatcggcgaaaaacgctga

SEQ ID NO: 40145 - protein, 173 aa, Neisseria meningitidis
MDDPRTYGSGNPGATNVLRSGKKKAAALTLLGDAAKGLVAVLLARVLQEPLGLSDSAIAAVALAALVGHMWPVFFGFKGGKGVATALGVLLALSPTTALVCALIWLVMAFGFKVSSLAALTATIAAPLAALFFMPHTSWIFATLAIAILVLLRHKSNILNLIKGKESKIGEKR

SEQ ID NO: 40146 - DNA, 612 bp, Neisseria gonorrhoeae
atgaaattacaacaattggctgaagaaaaaatcggcgttctgattgtgttcacgctgcttgtagtcagtgtcggtctgttgattgaagttgtgcccttggcctttaccaaggcggcaacacagccggcgccgggcgtgaagccttacaatgccctgcaggttgccggacgcgatatttacatccgtgagggctgttacaactgccactctcaaatgattcgtccgttccgtgcggaaaccgagcgttacggtcattactctgttgccggagagtcggtttacgaccatccgttccaatggggttccaaacgtaccggtcctgatttggcacgtgtgggcggccgctattccgacgaatggcaccgcatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcgcctgaggctttggcaaacaaatccgagctggatgctgtagtcgcctatctgcaaggattgggtctggctttgaaaaacgtaaggtaa

SEQ ID NO: 40147 - protein, 203 aa, Neisseria gonorrhoeae
MKLQQLAEEKIGVLIVFTLLVVSVGLLIEVVPLAFTKAATQPAPGVKPYNALQVAGRDIYIREGCYNCHSQMIRPFRAETERYGHYSVAGESVYDHPFQWGSKRTGPDLARVGGRYSDEWHRIHLLNPRDVVPESNMPAFPWLARNKVDVDATVANMKALRKVGTPYSDEEIAKAPEALANKSELDAVVAYLQGLGLALKNVR

SEQ ID NO: 40148 - DNA, 612 bp, Neisseria meningitidis
atgaaattacaacaattggctgaagaaaaaatcggcgttctgattgtgttcacgctgcttgtagtcagtgtcggtctgttgattgaagttgtgcccttggcctttaccaaggcggcaacacagccggcgccgggcgtgaagccttacaatgccctgcaggttgccggacgcgatatttacatccgtgagggctgttacaactgccactcgcaaatgattcgtccgttccgtgcggaaaccgagcgttacggtcattactctgttgccggagagtcggtttacgaccatccgttccaatggggttccaaacgtaccggtcctgatttggcacgtgtgggcggtcgctattccgacgaatggcaccgtatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcacctgaggctttggcaaacaaatccgagctggatgctgtagtcgcctatctgcaaggattgggtctggctttgaaaaacgtaaggtaa

SEQ ID NO: 40149 - protein, 203 aa, Neisseria meningitidis; identical to SEQ ID NO: 40147

SEQ ID NO: 40150 - DNA, 612 bp, Neisseria meningitidis
atgaaattacaacaattggctgaagaaaaaatcggcgttctgattgtgttcacgctgcttgtagtcagtgtcggtctgttgattgaagttgtgcccttggcctttaccaaggcggcaacacagccggcgtcgggcgtgaagccttacaatgccctgcaggttgccggacgcgatatttacatccgtgagggctgttacaactgccactcgcaaatgattcgtccgttccgtgcggaaaccgagcgttacggtcattactctgttgccggagagtcggtttacgaccatccgttccaatggggttccaaacgtaccggtcctgatttggcacgtgtgggcggtcgctattccgacgaatggcaccgtatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcgcctgaggctttggcaaacaaatccgagctggatgctgtagtcgcctatctgcaaggattgggtctggctttgaaaaacgtaaggtaa

SEQ ID NO: 40151 - protein, 203 aa, Neisseria meningitidis
MKLQQLAEEKIGVLIVFTLLVVSVGLLIEVVPLAFTKAATQPASGVKPYNALQVAGRDIYIREGCYNCHSQMIRPFRAETERYGHYSVAGESVYDHPFQWGSKRTGPDLARVGGRYSDEWHRIHLLNPRDVVPESNMPAFPWLARNKVDVDATVANMKALRKVGTPYSDEEIAKAPEALANKSELDAVVAYLQGLGLALKNVR

SEQ ID NO: 40152 - DNA, 1494 bp, Neisseria gonorrhoeae
atggatatggtgaacactaaaccgaatactagtgtgattaatatgctttctttccttaccggattattgagcttgggtatagaagtcttgtgggtaaggatgttttcgttcgcagcacagtccgtgcctcaggcattttcatttattcttgcctgttttctgaccggtatcgccgtcggcgcgtattttggcaaacggatttgccgcagccgctttgttgatattccctttatcgggcagtgcttcttgtgggcgggtattgccgattttttgattttgggtgctgcgtggttgttgacgggtttttccggtttcgtccaccacgccggtattttcattaccctgtctgccgtcgtcagggggttgattttcccacttgtacaccatgtgggtacggatggcaacaaatccggacgacaggtttccaatgtttatttcgccaacgttgccggcagtgcattgggtccggtccttatcggctttgtgatacttgatttgttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctggccgtccggataggttgattgaaaacaaacacggcattgttgcggtttaccatagagatggtgataaggttgtttatggggcgaatgtatacgacggcgcatacaataccgatatattcaatagtgtcaacggcatcgaacgtgcctatctgctaccctccctgaagtccggcatacgccgcattttcgtcgttggattgagtacaggttcgtgggcgcgcgtcttgtctgccattccggaaatgcagtcgatgatcgttgcggaaatcaatccggcataccgtagccttatcgcggacgagccgcaaatcgcaccgcttttgcaggacaaacgtgttgaaattgtattggatgacggtaggaaatggctgcgtcgccatcctgatgaaaaattcgacctgattttgatgaattcgacttggtactggcgtgcctattccactaacctgttgagtgcggaatttttaaaacaggtgcaaagccaccttaccccggatggtattgtaatgtttaataccacgcacagcccgcatgcttttgctaccgccgtacacagtattccctatgcataccgctacgggcatatggtagtcggctcggcaaccccggtagttttccctaataaagaactgctcaagcaacgcctttcccggttgatttggccggaaagcggcaggcacgtatttgacagcagcaccgtggatgctgcagcacaaaaggttgtctctcgtatgctgattcggatgacggaaccttcggctggggcggaagtcattactgacgataatatgattgtagaatacaaatacggcagagggatttaa

SEQ ID NO: 40153 - protein, 497 aa, Neisseria gonorrhoeae
MDMVNTKPNTSVINMLSFLTGLLSLGIEVLWVRMFSFAAQSVPQAFSFILACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDLLSTQQIYLLICLISAAVPLFCTLFQKSLRLNAVSVAVSLMFGILMFLLPDSVFQNIAGRPDRLIENKHGIVAVYHRDGDKVVYGANVYDGAYNTDIFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNSTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIRMTEPSAGAEVITDDNMIVEYKYGRGI

SEQ ID NO: 40154 - DNA, 1494 bp, Neisseria meningitidis
  misc_feature (47)..(47): n is a, c, g, or t
atggatatagtgaacactaaaccgaatactagtttgatttatatgcnttctttccttagcggcttattgagcttgggtatagaagtcttgtgggtgaggatgttttcgttcgcagcacagtccgtgcctcaggcattttcatttacccttgcctgttttctgaccggtatcgccgtcggcgcgtattttggcaaacggatttgccgcagccgctttgttgatattccctttatcgggcagtgcttcttgtgggcgggtattgccgactttttgattttgggtgctgcgtggttgttgacgggtttttccggcttcgtccaccacgccggtatcttcattaccctgtctgccgtcgtcasasggttgattttcccgctcgtacaccatgtgggtacggatggcaacaaatccggacgacaggtttccaatgtttatttcgccamcgttgccggcagtgcattgggtccggtccttatcggctttgtgatacttgatttcttgtccacccaacagatttacctgctcatctgtwtgatttctgctgctgtccctttgttttgtacactgttccaaaaaagtctccgactgaatgcagtgtcggtagcagtttccctaatgttcggcatcctcatgttcytactgccggattctgtctttcaaaatattgctgaccgtccggataggctgattgaaaacaaacacggcattgttgcggtttaccatagagatggtgataaggttgtttatggggcgaatgtatacgacggcgcatacaataccgatgtattcaatagtgtcaacggcatcgaacgtgcctatctgctaccctccctgaagtctggcatacgccgcattttcgtcgttggactgagtacaggttcgtgggcgcgcgtcttgtctgccattccggaaatgcagtcgatgatcgttgcggaaatcaatccggcataccgtagccttatcgcggacgagccgcaaatcgccccgcttttgcaggacaaacgtgttgaaattgtattggatgacggtaggaaatggctgcgtcgccatcctgatgaaaaattcgacctgattttgatgaatacgacttggtactggcgtgcctattccaccaacctgttgagtgcggaatttttaaaacaggtgcaaagccaccttaccccggatggtattgtaatgtttaataccacgcacagcccgcatgcttttgctaccgccgtacacagtattccctatgcataccgctatgggcatatggtagtcggctcggcaaccccggtagttttccctaataaagaactgctcaagcaacgtctctcccggttgatttggccggaaagcggcaggcacgtatttgacagcagcaccgtggatgctgcagcacaaaaggttgtctctcgtatgctgattcagatgacggaaccttcggctggggcggaagttattaccgacgataatatgattgtagaatacaaatacggcagagggatttaa

SEQ ID NO: 40155 - protein, 497 aa, Neisseria meningitidis
  misc_feature (16)..(16): Xaa can be any naturally occurring amino acid
  misc_feature (120)..(121): Xaa can be any naturally occurring amino acid
  misc_feature (148)..(148): Xaa can be any naturally occurring amino acid
  misc_feature (178)..(178): Xaa can be any naturally occurring amino acid
MDIVNTKPNTSLIYMXSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVXXLIFPLVHHVGTDGNKSGRQVSNVYFAXVAGSALGPVLIGFVILDFLSTQQIYLLICXISAAVPLFCTLFQKSLRLNAVSVAVSLMFGILMFLLPDSVFQNIADRPDRLIENKHGIVAVYHRDGDKVVYGANVYDGAYNTDVFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNTTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIQMTEPSAGAEVITDDNMIVEYKYGRGI

SEQ ID NO: 40156 - DNA, 1494 bp, Neisseria meningitidis
atggatatagtgaacactaaaccgaatactagtttgatttatatgctttctttccttagcggcttattgagcttgggtatagaagtcttgtgggtaaggatgttttcgttcgcagcacagtccgtgcctcaggcattttcatttactcttgcctgttttctgaccggtatcgccgtcggcgcgtattttggcaaacggatttgccgcagccgctttgttgatattccctttatcgggcagtgcttcttgtgggcgggtattgccgactttttgattttgggtgctgcgtggttgttgacgggtttttccggcttcgtccaccacgccggtatcttcattaccctgtctgccgtcgtcagagggttgattttcccgctcgtacaccatgtgggtacggatggcaacaaatccggacgacaggtttccaatgtttatttcgccaacgttgccggcagtgcattgggtccggtccttatcggctttgtgatacttgatttcttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctgaccgtccggataggctgattgaaaacaaacacggcattgttgcggtttaccatagagatggtgataaggttgtttatggggcgaatgtatacgacggcgcatacaataccgatgtattcaatagtgtcaacggcatcgaacgtgcctatctgctaccctccctgaagtctggcatacgccgcattttcgtcgttggattgagtacaggttcgtgggcgcgcgtcttgtctgccattccggaaatgcagtcgatgatcgttgcggaaatcaatccggcataccgtagccttatcgcggacgagccgcaaatcgccccgcttttgcaggacaaacgtgttgaaattgtattggatgacggtaggaaatggctgcgtcgccatcctgatgaaaaattcgacctgattttgatgaatacgacttggtactggcgtgcctattccaccaacctgttgagtgcggaatttttaaaacaggtgcaaagccaccttaccccggatggtattgtaatgtttaataccacgcacagcccgcatgcttttgctaccgccgtacacagtattccctatgcataccgctatgggcatatggtagtcggctcggcaaccccggtagttttccctaataaagaactgctcaagcaacgtctctcccggttgatttggccggaaagcggcaggcacgtatttgacagcagcaccgtggatgctgcagcacaaaaggttgtctctcgtatgctgattcagatgacggaaccttcggctggtgcggaagtcattaccgacgataatatgattgtagaatacaaatacggcagagggatttaa

SEQ ID NO: 40157 - protein, 497 aa, Neisseria meningitidis
MDIVNTKPNTSLIYMLSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDFLSTQQIYLLICLISAAVPLFCTLFQKSLRLNAVSVAVSLMFGILMFLLPDSVFQNIADRPDRLIENKHGIVAVYHRDGDKVVYGANVYDGAYNTDVFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNTTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIQMTEPSAGAEVITDDNMIVEYKYGRGI

SEQ ID NO: 40158 - DNA, 963 bp, Neisseria gonorrhoeae; identical to SEQ ID NO: 38801

SEQ ID NO: 40159 - protein, 320 aa, Neisseria gonorrhoeae; identical to SEQ ID NO: 38802

SEQ ID NO: 40160 - DNA, 963 bp, Neisseria meningitidis; identical to SEQ ID NO: 38799

SEQ ID NO: 40161 - protein, 320 aa, Neisseria meningitidis; identical to SEQ ID NO: 38800

SEQ ID NO: 40162 - DNA, 963 bp, Neisseria meningitidis; identical to SEQ ID NO: 38803

SEQ ID NO: 40163 - protein, 320 aa, Neisseria meningitidis; identical to SEQ ID NO: 38804

SEQ ID NO: 40164 - DNA, 1677 bp, Neisseria gonorrhoeae
atggtcggacggaccttgaccgcagataccgacatatttgttctgcttgcggcaggcggagatggcaagatgcagcatcactttgacggcagggttgcgttcgtcaaacgattcggacaccaagccgctgtctcggtcgaggccgagggtcagctgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcaatgccttaaccactgcttcggcttcgcccaaagtgcggacgaacggaatcatgatttcgacgttggtcagacccatttcgtcacgaacgcgtttcaaggctttgcattccaaggcgaaacagtctttgaagctctcggcaacataacgcgccgcaccacggaagcccaacatcgggttttcttcatgcggttcgtatacgctgccgccgaccaggttggcgtattcgttggatttgaagtcggacatacggacgatggttttacgcggataaaccgatgcggcaagcgttgccacgccttcggcgattttatcgacgtagaagtcgacaggggatgcgtaaccggcgatgcggcggataatttccgctttcagttcgtcgtcttgtttgtcaaattccaacaaggctttcgggtggatgccgatttggcggttgatgataaattccatacgcgccaagccgatgccttcgctgggcagattggcgaagctgaatgcgagttcgggattgccgacgttcatcatgactttgacgggtgcttttggcatattgtccaaggcgacatcggtaatttgtacgtccagcaggccggcatagataaagccggtatcgccttcggcacaggatacggtaacttcctgaccgttttccaagagttcggtcgcattgccgcagccgacgacggcaggaatacccagttcgcgcgcgatgatggcggcgtggcaggtgcgtccgccgcggttggtcacgatggcggaagcacgtttcatcacgggttcccaatccggatcggtcatgtcggtaaccagtacgtcgccggcttcgacggaatccatctcggaagcatctttaatcaggcgcaccttgccctgaccgactttttgaccgatggcacgaccttcgcacaagacggttttttcgccgttgatggcgtagcggcgcaggttgcggctgccttcttcttgggatttgacggtttcggggcgggcttgcaggatgtagagtttgccgtccaggccgtcgcgtccccattcgatatccatcgggcggccgtagtgtttttcgatggtcagcgcgtagtgtgccaactcggtgatttcttcgtcggtaatggagaagcggttgcggtcttcttcggggacttcgacgttggttaccgatttgccggcttcggctttgtcggtgaaaatcattttgatgtgtttcgaacccatggtcttgcgcaggatggcgggtttgcctgctttgagcgtgggtttgaacacataaaattcgtccgggttgaccgcgccttgtacgacgttttcgcccagaccgtaagaggaggtaacaaagacgacttggttgtagccggattcggtgtcgagggtgaacatcacacctga

SEQ ID NO: 40165 - protein, 558 aa, Neisseria gonorrhoeae
MVGRTLTADTDIFVLLAAGGDGKMQHHFDGRVAFVKRFGHQAAVSVEAEGQLGHVVRADGEAVEVLQELFRQYRVARQLAHHNQAQAVFAAFQAVFFQCLNHCFGFAQSADERNHDFDVGQTHFVTNAFQGFAFQGETVFEALGNITRRTTEAQHRVFFMRFVYAAADQVGVFVGFEVGHTDDGFTRINRCGKRCHAFGDFIDVEVDRGCVTGDAADNFRFQFVVLFVKFQQGFRVDADLAVDDKFHTRQADAFAGQIGEAECEFGIADVHHDFDGCFWHIVQGDIGNLYVQQAGIDKAGIAFGTGYGNFLTVFQEFGRIAAADDGRNTQFARDDGGVAGASAAVGHDGGSTFHHGFPIRIGHVGNQYVAGFDGIHLGSIFNQAHLALTDFLTDGTTFAQDGFFAVDGVAAQVAAAFFLGFDGFGAGLQDVEFAVQAVASPFDIHRAAVVFFDGQRVVCQLGDFFVGNGEAVAVFFGDFDVGYRFAGFGFVGENHFDVFRTHGLAQDGGFACFERGFEHIKFVRVDRALYDVFAQTVRGGNKDDLVVAGFGVEGEHHT

SEQ ID NO: 40166 - DNA, 1677 bp, Neisseria meningitidis
atggtcggacsggccttgaccgcagatgccgacatatttgttctgcttgcggcaggcggagatggcaaggtgcagcatcactttgacggcagggttgcgttcgtcaaacgattcggataccaagccgctgtcgcggtcgagaccgagggtcagttgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcagggctttgacaacggmttcggcttcgcccaaagtgcggacgaacggaatcatgatttcaacgttggycaaccccatttcatcgcggacgcgtttcaaggctttgcattccaaggcgaaacagtctttgaagttgtcggcgacataacgcgccgcaccacggaagcccaacatcgggttttcttcatgcggttcgtatacgttgccgccgaccaggttggcgtattcgttggatttgaagtcggacatacggacgatggttttacgcggataaaccgatgcggccaatgtcgccacgccttcggcgattttatcgacgtagaagtcgacaggggacgcgtaaccggcgatacggcgggtaatttccgcttttaattcgtcgtcttgtttgtcaaattccaacaargctttggggtggataccgatttggcggttgatgataaattccatacgcgccaagccgatgccttcgctgggcaggttggcgaagctgaatgcgagttcgggattgccgacgttcatcatgacttttacaggtgctttaggcatattgtctaaggcgacatcggtaatctgtacgtccaacagaccggcatagataaagccggtatcgccttcggcacaggatacggtaacttcttgaccgtttttcagcaattcggttgcattgccgcagccgacaacggcaggaatgcccaattcacgcgcgatgatggcggcgtggcaggtacggccgccgcggttggtaacgatggcagaagcacgtttcatcacgggttcccaatccggatcggtcatgtcggtaacgagtacgtcgccggcttcgacggaatccatctcggaagcatctttaatcaggcgcaccttgccctgaccgactttctgaccgatggcgcggccttcgcataatacggttttgtcgccgttgatggcgaagcggcgcaggttgcggttgccctcttcttgggattttacggtttcgggacgggcttgcaggatgtagagtttgccgtccaagccgtcgcgtccccattcgatatccatcgggcggccgtagtgtttttcgatggtcagtgcgtaatgcgccaactcagtaatttcttcgtcggtaatggagaagcggttgcggtcttcctcggggacatcgacgttggttacggatttaccggcttctgctttgtcggtaaaaatcattttgatgtgttttgaacccatggttttacgcaggatggcgggcttgcccgytttgagcgtgggtttgaacacatraaattcgtccgggttgaccgcaccttgtacgacgttttcgcccagaccgtaagaggaggtaacaaagacgacytgatcgtakccggattcggtgtcgagggtgaacatcacacctga

SEQ ID NO: 40167 - protein, 558 aa, Neisseria meningitidis
  misc_feature (4)..(4): Xaa can be any naturally occurring amino acid
  misc_feature (222)..(222): Xaa can be any naturally occurring amino acid
  misc_feature (233)..(233): Xaa can be any naturally occurring amino acid
  misc_feature (283)..(283): Xaa can be any naturally occurring amino acid
  misc_feature (400)..(400): Xaa can be any naturally occurring amino acid
  misc_feature (500)..(500): Xaa can be any naturally occurring amino acid
  misc_feature (520)..(520): Xaa can be any naturally occurring amino acid
  misc_feature (548)..(548): Xaa can be any naturally occurring amino acid
MVGXALTADADIFVLLAAGGDGKVQHHFDGRVAFVKRFGYQAAVAVETEGQLGHVVRADGEAVEVLQELFRQYRVARQLAHHNQAQAVFAAFQAVFFQGFDNGFGFAQSADERNHDFNVGQPHFIADAFQGFAFQGETVFEVVGDITRRTTEAQHRVFFMRFVYVAADQVGVFVGFEVGHTDDGFTRINRCGQCRHAFGDFIDVEVDRGRVTGDTAGNFRFXFVVLFVKFQQXFGVDTDLAVDDKFHTRQADAFAGQVGEAECEFGIADVHHDFYRCFRHIVXGDIGNLYVQQTGIDKAGIAFGTGYGNFLTVFQQFGCIAAADNGRNAQFTRDDGGVAGTAAAVGNDGRSTFHHGFPIRIGHVGNEYVAGFDGIHLGSIFNQAHLALTDFLTDGAAFAXYGFVAVDGEAAQVAVALFLGFYGFGTGLQDVEFAVQAVASPFDIHRAAVVFFDGQCVMRQLSNFFVGNGEAVAVFLGDIDVGYGFTGFCFVGKNHFDVFXTHGFTQDGGLARFERGFEHXKFVRVDRTLYDVFAQTVRGGNKDDLIVXGFGVEGEHHT

SEQ ID NO: 40168 - DNA, 1671 bp, Neisseria meningitidis
atggtcggacgggccttgaccgcagatgccgacatatttgttctgcttgcggcaggcggagatggcaaggtgcagcatcactttgacggcagggttgcgttcgtcaaacgattcggataccaagccgctgtcgcggtcgagaccgagggtcagttgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcagggctttgacaacggcttcggcttcgcccaaagtgcggacgaacggaatcatgatttcaacgttggtcaaccccatttcatcgcggacgcgtttcaaggctttgcattccaaggcgaaacagtctttgaagttgtcggcgacataacgcgccgcaccacggaagcccaacatcgggttttcttcatgcggttcgtatacgttgccgccgaccaggttggcgtattcgttggatttgaagtcggacatacggacgatggttttacgcggataaaccgatgcggccaatgtcgccacgccttcggcgattttatcgacgtagaagtcgacaggggacgcgtaaccggcgatacggcgggtaatttccgcttttaattcgtcgtcttgtttgtcaaattccaacaaggctttggggtggataccgatttggcggttgatgataaattccatacgcgccaagccgatgccttcgctgggcaggttggcgaagctgaatgcgagttcgggattgccgacgttcatcatgacttttacaggtgctttaggcatgttgtccaaagcaacatcggtaatttgtacgtccagcaggccggagtagatgaagccggtatcgccttcggcacaggatacggtaacttcttgaccgtttttcagcaattcggttgcattgccgcagccgacaacggcaggaatacccagttcgcgcgcgatgatggcggcgtggcaggtacgtccgcccctgttggtcacgatggcggaagcgcgtttcatcaccggttcccaatctgggtcggtcatgtcggtaaccagtacgtcgccggcttcgacggaatccatctcggaagcatctttaatcaggcgtaccttgccctgaccgactttctgaccgatggcgcggccttcgcacaagacggttttttcgccgttgatagaaaagcggcgcaggttgcggctgccttcttcctgggatttgacggtttcgggacgggcttgcaggatgtagagtttgccgtccaagccgtcgcgtccccattcgatgtccatcgggcggccgtagtgtttttcgatggtcagtgcgtaatgcgccaactcggtgatttcttcgtcggtaatggagaagcggttgcggtcttcttcggggacatcgacgttggttaccgatttgccggcttctgctttgtcggtaaaaatcattttgatgtgttttgagcccatggttttgcgcaggatggcaggtttgcctgctttcagcgtgggtttgaacacatagaattcgtcgggattgactgcgccttgtacgacgttttcgcccagaccgtaggatgaagtgacaaagacgacttggtcgtaaccggattcggtatcgagggtgaacatcac

SEQ ID NO: 40169 - protein, 554 aa, Neisseria meningitidis
MVGRALTADADIFVLLAAGGDGKVQHHFDGRVAFVKRFGYQAAVAVETEGQLGHVVRADGEAVEVLQELFRQYRVARQLAHHNQAQAVFAAFQAVFFQGFDNGFGFAQSADERNHDFNVGQPHFIADAFQGFAFQGETVFEVVGDITRRTTEAQHRVFFMRFVYVAADQVGVFVGFEVGHTDDGFTRINRCGQCRHAFGDFIDVEVDRGRVTGDTAGNFRFFVVLFVKFQQGFGVDTDLAVDDKFHTRQADAFAGQVGEAECEFGIADVHHDFYRCFRHVVQSNIGNLYVQQAGVDEAGIAFGTGYGNFLTVFQQFGCIAAADNGRNTQFARDDGGVAGTSAPVGHDGGSAFHHRFPIWVGHVGNQYVAGFDGIHLGSIFNQAYLALTDFLTDGAAFAQDGFFAVDRKAAQVAAAFFLGFDGFGTGLQDVEFAVQAVASPFDVHRAAVVFFDGQCVMRQLGDFFVGNGEAVAVFFGDIDVGYRFAGFCFVGKNHFDVFAHGFAQDGRFACFQRGFEHIEFVGIDCALYDVFAQTVGSDKDDLVVTGFGIEGEHH

SEQ ID NO: 40170 - DNA, 507 bp, Neisseria gonorrhoeae
atgatgaaaccgcacaacctgttccaattcctcgccgtttgctccctgaccgtcgccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctcttcaaatgggaatacactttgccctacagacagactattgtcggcgacggtcaaaccgtttggctctacgatgttgatttggcacaagtgaccaagtcgtcccaagaccaggccatcggcggcagccccgccgccatcctgtcgaacaaaaccgccctcgaaagcagttacacgctgaaagaggacggttcgtccaacggcatcgattatgtgcggggcaacgcccaaacgcaacaacgccggctaccaatacatccgcatcggcttcaaaggcggcaacctcgccgccatgcagcttaa

SEQ ID NO: 40171 - protein, 168 aa, Neisseria gonorrhoeae
MMKPHNLFQFLAVCSLTVAVASAQAGAVDALKQFNNDADGISGSFTQTVQSKKKTQTAHGTFKILRPGLFKWEYTLPYRQTIVGDGQTVWLYDVDLAQVTKSSQDQAIGGSPAAILSNKTALESSYTLKEDGSSNGIDYVRGNAQTQQRRLPIHPHRLQRRQPRRHAA

SEQ ID NO: 40172 - DNA, 503 bp, Neisseria meningitidis
atgatgaaaccgcacaacctgttccaattcctcgccgtttgctccctgaccgtcgccgtcgcttccgcacaggcgggcgcggtagacgcgcttaagcaattcaacaacgatgccgacggtatcagcggcagcttcacccaamccgtccaawgcaaaaagaaaacccaaaccgcgcacggcacgttcaaaatcctgcgaccgggccttttcaaatgggaatacaccaaacttacaggcaaaccatcgtcggcgacggtcaaacygtttggctmtacgatgtygatctggcacaagtgaccaagtcgtcccaagaccaggccataggcgscagccccgccgccatcctgtcgaacaaarccgccctcgaaagcagctacacgctgaaagaggacggttcgtccaacggcatcgattatgtgggcaacgcccaaacgcaacaacgccggctaccaatacatccgcatcggcttcaaaggcggcaacctcgccgccatgcagctyaa

SEQ ID NO: 40173 - protein, 168 aa, Neisseria meningitidis
  misc_feature (48)..(48): Xaa can be any naturally occurring amino acid
  misc_feature (51)..(51): Xaa can be any naturally occurring amino acid
  misc_feature (110)..(110): Xaa can be any naturally occurring amino acid
  misc_feature (120)..(120): Xaa can be any naturally occurring amino acid
  misc_feature (168)..(168): Xaa can be any naturally occurring amino acid
MMKPHNLFQFLAVCSLTVAVASAQAGAVDALKQFNNDADGISGSFTQXVQXKKKTQTAHGTFKILRPGLFKWEYTKLYRQTIVGDGQTVWLYDVDLAQVTKSSQDQAIGXSPAAILSNKXALESSYTLKEDGSSNGIDYVGNAQTQQRRLPIHPHRLQRRQPRRHAAX

SEQ ID NO: 40174 - DNA, 504 bp, Neisseria meningitidis
atgatgaaaccgcacaacctgttccaattcctcgccgtttgctccctgaccgtctccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctctttaaatgggaatacacttcgccttacaaacagactattgtcggcgacggtcaaaccgtttggctctacgatgtcgatttggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgggcaacgcccaaacgcaacaacgccggctaccaatacatccgcatcggcttcaaaggcggcaacctcgccgccatgcagcttaa

SEQ ID NO: 40175 - protein, 167 aa, Neisseria meningitidis
MMKPHNLFQFLAVCSLTVSVASAQAGAVDALKQFNNDADGISGSFTQTVQSKKKTQTAHGTFKILRPGLFKWEYTSPYKQTIVGDGQTVWLYDVDLAQVTKSSQDQAIGGSPAAILSNKTALESSYTLKEDGSSNGIDYVGNAQTQQRRLPIHPHRLQRRQPRRHAA

SEQ ID NO: 40176 - DNA, 624 bp, Neisseria gonorrhoeae
atgatgaaaccgcacaacctgttccaattcctcgccgtttgctccctgaccgtcgccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctcttcaaatgggaatacactttgccctacagacagactattgtcggcgacggtcaaaccgtttggctctacgatgttgatttggcacaagtgaccaagtcgtcccaagaccaggccatcggcggcagccccgccgccatcctgtcgaacaaaaccgccctcgaaagcagttacacgctgaaagaggacggttcgtccaacggcatcgattatgtgcgggcaacgcccaaacgcaacaacgccggctaccaatacatccgcatcggcttcaaaggcggcaacctcgccgccatgcagcttaaagacagcttcggcaaccaaacctccatcagtttcggcggtttgaataccaatccccaactctcgcgcggcgcgttcaagtttaccccgcccaaaggcgtggacgtgttgagcaactga

SEQ ID NO: 40177 - protein, 207 aa, Neisseria gonorrhoeae
MMKPHNLFQFLAVCSLTVAVASAQAGAVDALKQFNNDADGISGSFTQTVQSKKKTQTAHGTFKILRPGLFKWEYTLPYRQTIVGDGQTVWLYDVDLAQVTKSSQDQAIGGSPAAILSNKTALESSYTLKEDGSSNGIDYVRATPKRNNAGYQYIRIGFKGGNLAAMQLKDSFGNQTSISFGGLNTNPQLSRGAFKFTPPKGVDVLSN

SEQ ID NO: 40178 - DNA, 624 bp, Neisseria meningitidis
atgatgaaaccgcacaacctgttccaattcctcgccgtttgctccctgaccgtcgccgtcgcttccgcacaggcgggcgcggtagacgcgcttaagcaattcaacaacgatgccgacggtatcagcggcagcttcacccaaaccgtccaaagcaaaaagaaaacccaaaccgcgcacggcacgttcaaaatcctgcgaccgggccttttcaaatgggaatacaccaaaccttacaggcaaaccatcgtcggcgacggtcaaaccgtttggctctacgatgttgatctggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgctggcaacgcccaaacgcaacaacgccggctaccaatacatccgcatcggcttcaaaggcggcaacctcgccgccatgcagcttaaagacagcttcggcaaccaaacctccatcagtttcggcggtttgaataccaatccccaactctcgcgcggcgcgttcaagtttaccccgcccaaaggcgtggacgtgttgagcaactga

SEQ ID NO: 40179 - protein, 207 aa, Neisseria meningitidis
MMKPHNLFQFLAVCSLTVAVASAQAGAVDALKQFNNDADGISGSFTQTVQSKKKTQTAHGTFKILRPGLFKWEYTKPYRQTIVGDGQTVWLYDVDLAQVTKSSQDQAIGGSPAAILSNKTALESSYTLKEDGSSNGIDYVLATPKRNNAGYQYIRIGFKGGNLAAMQLKDSFGNQTSISFGGLNTNPQLSRGAFKFTPPKGVDVLSN

SEQ ID NO: 40180 - DNA, 624 bp, Neisseria meningitidis
atgatgaaaccgcacaacctgttccaattcctcgccgtttgctccctgaccgtctccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctctttaaatgggaatacacttcgccttacaaacagactattgtcggcgacggtcaaaccgtttggctctacgatgtcgatttggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgctggcaacgcccaaacgcaacaacgccggctaccaatacatccgcatcggcttcaaaggcggcaacctcgccgccatgcagcttaaagacagcttcggcaatcaaacctccatcagtttcggcggtttgaataccaatccccaactctcgcgcggcgcgttcaagtttaccccgcccaaaggcgtggacgtgttgagcaactga

SEQ ID NO: 40181 - protein, 207 aa, Neisseria meningitidis
MMKPHNLFQFLAVCSLTVSVASAQAGAVDALKQFNNDADGISGSFTQTVQSKKKTQTAHGTFKILRPGLFKWEYTSPYKQTIVGDGQTVWLYDVDLAQVTKSSQDQAIGGSPAAILSNKTALESSYTLKEDGSSNGIDYVLATPKRNNAGYQYIRIGFKGGNLAAMQLKDSFGNQTSISFGGLNTNPQLSRGAFKFTPPKGVDVLSN

SEQ ID NO: 40182 - DNA, 207 bp, Neisseria gonorrhoeae
atgtccgcgccgtcggcatcggtaatcattttgttccatgccgcttcgatttcggcatcgagctgttcggggaagggcgtgtccaaaatccattggcggatttctttgccgacgcgtgccagttcggaaacgtcttcgacatccaattttgccagagcggcggaaatgcgttcgttcagaccgttgtgtgcgagaaatgcgcggtag

SEQ ID NO: 40183 - protein, 68 aa, Neisseria gonorrhoeae
MSAPSASVIILFHAASISASSCSGKGVSKIHWRISLPTRASSETSSTSNFARAAEMRSFRPLCARNAR

SEQ ID NO: 40184 - DNA, 207 bp, Neisseria meningitidis
atgtccgcaccgccggcatcggcaaccattttgttccatgccgcttcgatttcggcatcgagctgttcggggaaaggcgtatccaaaatccattggcggatttctttgccgacgcgtgccagttcggcaacgtcttcgacatccaattttgccagtgcggcggaaatgcgttcgctcagaccgttgtgtgcgaggaatgcgcggtag

SEQ ID NO: 40185 - protein, 68 aa, Neisseria meningitidis
MSAPPASATILFHAASISASSCSGKGVSKIHWRISLPTRASSATSSTSNFASAAEMRSLRPLCARNAR

SEQ ID NO: 40186 - DNA, 207 bp, Neisseria meningitidis
atgtccgcgccgccggcatcggcaaccattttgttccatgccgcttcgatttcggcatcgagctgttcggggaagggcgtgtccaaaatccattggcggatttctttgccgacgcgtgccagttcggcaacgtcttcgacatctaattttgccagtgcggcggaaatgcgttcgctcagaccgttgtgtgcgaggaatgcgcggtag

SEQ ID NO: 40187 - protein, 207 aa, Neisseria meningitidis
ATGTCCGCGCCGCCGGCATCGGCAACCATTTTGTTCCATGCCGCTTCGATTTCGGCATCGAGCTGTTCGGGGAAGGGCGTGTCCAAAATCCATTGGCGGATTTCTTTGCCGACGCGTGCCAGTTCGGCAACGTCTTCGACATCTAATTTTGCCAGTGCGGCGGAAATGCGTTCGCTCAGACCGTTGTGTGCGAGGAATGCGCGGTAG

SEQ ID NO: 40188 - DNA, 360 bp, Neisseria gonorrhoeae
atggcgcggtcgttgtacagggaggcgaaaacgtggcgcatcgcttttttaacgttatccaagccattgatattcaggaaggtttcctgttggccggcaaatgatgcgtcgggcaggtcttcggcggttgcggaagagcgtacggcaacggaaatgtccgcgccgtcggcatcggtaatcattttgttccatgccgcttcgatttcggcatcgagctgttcggggaagggcgtgtccaaaatccattggcggatttctttgccgacgcgtgccagttcggaaacgtcttcgacatccaattttgccagagcggcggaaatgcgttcgttcagaccgttgtgtgcgagaaatgcgcggtag

SEQ ID NO: 40189 - protein, 119 aa, Neisseria gonorrhoeae
MARSLYREAKTWRIAFLTLSKPLIFRKVSCWPANDASGRSSAVAEERTATEMSAPSASVIILFHAASISASSCSGKGVSKIHWRISLPTRASSETSSTSNFARAAEMRSFRPLCARNAR

SEQ ID NO: 40190 - DNA, 360 bp, Neisseria meningitidis
atggcacggtcgttatacagggaagcgaatacatggtgcatcgcttctttaacgttatccaagccgttgatgttcaagaaggtttcctgttgtccagcgaatgatgcgtccggcaggtcttcggcagttgcggaagaacgtacggcaacggaaatgtccgcaccgccggcatcggcaaccattttgttccatgccgcttcgatttcggcatcgagctgttcggggaaaggcgtatccaaaatccattggcggatttctttgccgacgcgtgccagttcggcaacgtcttcgacatccaattttgccagtgcggcggaaatgcgttcgctcagaccgttgtgtgcgaggaatgcgcggtag

SEQ ID NO: 40191 - protein, 119 aa, Neisseria meningitidis
MARSLYREANTWCIASLTLSKPLMFKKVSCCPANDASGRSSAVAEERTATEMSAPPASATILFHAASISASSCSGKGVSKIHWRISLPTRASSATSSTSNFASAAEMRSLRPLCARNAR

SEQ ID NO: 40192 - DNA, 360 bp, Neisseria meningitidis
atggcgcggtcgttgtacagggaggcgaatacatggcgcatcgcttctttaacgttttccaagccgttgatattcaggaaggtttcctgttggccggcaaatgatgcgtcgggcaggtcttcggcggttgcggaagagcgtacggcaacggaaatgtccgcgccgccggcatcggcaaccattttgttccatgccgcttcgatttcggcatcgagctgttcggggaagggcgtgtccaaaatccattggcggatttctttgccgacgcgtgccagttcggcaacgtcttcgacatctaattttgccagtgcggcggaaatgcgttcgctcagaccgttgtgtgcgaggaatgcgcggtag

SEQ ID NO: 40193 - protein, 119 aa, Neisseria meningitidis
MARSLYREANTWRIASLTFSKPLIFRKVSCWPANDASGRSSAVAEERTATEMSAPPASATILFHAASISASSCSGKGVSKIHWRISLPTRASSATSSTSNFASAAEMRSLRPLCARNAR

SEQ ID NO: 40194 - DNA, 1278 bp, Neisseria gonorrhoeae
atgttggttcaggacttgccttttgaagtcaaactgaaaaaattccatatcgatttttacaatacgggtatgccgcgcgattttgccagcgatattgaagtaacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgagggatgcttcgcgcgaacctgtcgtgttgaaggcaacctccatacaccagtttccgttggaaatcggcaaacacaaatatcgtcttgagttcgatcagttcacttctatgaatgtggaggacatgagcgagggtgcggaacgggaaaaaagcctgaaatccactctgaacgatgtccgcgccgttactcaggaaggtaaaaaatacaccaatatcggcccttccatcgtgtaccgcatccgtgatgcggcagggcaggcggtcgaatataaaaactatatgctgccgattttgcaggacaaagattatttttggctgaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaagacgcacctgccgaaatccgcgaacaattcatgctggctgcggaaaacacgctgaatatctttgcgcaaaaaggctatttgggattggacgaatttattacgtccaatatcccgaaagggcagcaggataagatgcagggctatttctacgaaatgctttacggcgtgatgaacgctgctttggatgaaaccatacgccggtacggcttgcccgaatggcagcaggatgaagcgcggaaccgtttcctgctgcacagtatggatgcctatacggggctgacggaatatcccgcgcctatgctgctccagcttgacgggttttccgaggtgcgttcctcaggtttgcagatgacccgttcgccgggtgcgcttttggtctatctcggctcggtattgttggttttgggtacagtatttatgttttatgtgcccaaaaaacgggcgtgggtattgttttcaaacdgcaaaatccgttttgctatgtcttcggcccgcagcgaacgggatttgcagaaggaatttccaaaacacgtcgagagcctgcaacggctcggcaaggacttgaatcatgactga

SEQ ID NO: 40195 - protein, 424 aa, Neisseria gonorrhoeae
MLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVPKKRAWVLFSNKIRFAMSSARSERDLQKEFPKHVESLQRLGKDLNHD

SEQ ID NO: 40196 - DNA, 1274 bp, Neisseria meningitidis
atattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgmmcgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatga

SEQ ID NO: 40197 - protein, 425 aa, Neisseria meningitidis
  misc_feature (136)..(136): Xaa can be any naturally occurring amino acid
ILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLXDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 40198 - DNA, 1278 bp, Neisseria meningitidis
atattggttcaggacttgccttttgaagtcaaactgaaaaaattccatatcgatttttacaatacgggtatgccgcgcgattttgccagtgatattgaagtaacggataaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagtttacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactga

SEQ ID NO: 40199 - protein, 425 aa, Neisseria meningitidis
ILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 40200 - DNA, 894 bp, Neisseria gonorrhoeae
atgtttcgtttacaattcaggctgtttccccctttgcgaaccgccatgcacatcctgttgaccgccctgctcaaatgcctctccctgctgtcgctttcctgtctgcacacgctgggaaaccggctcggacatctggcgttttaccttttaaaggaagaccgcgcgcgcatcgtcgccaatatgcggcaggcgggtttgaaccccgacacgcagacggtcaaagccgtttttgcggaaacggcaaaatgcggtttggaacttgcccccgcgtttttcaaaaaaccggaagacatcgaaacaatgttcaaagcggtacacggctgggaacacgtgcagcaggctttggacaagggcgaagggctgctgttcatcacgccgcacatcggcagctacgatttgggcggacgctacatcagccagcagcttccgttccacctgaccgccatgtacaagccgccgaaaatcaaagcgatagacaaaatcatgcaggcgggcagggtgcgcggcaaaggcaaaaccgcgcccaccggcatacaaggggtcaaacaaatcatcaaggccctgcgcgcgggcgaggcaaccatcatcctgcccgaccacgtcccttctccgcaggaaggcggcggcgtgtgggcggattttttcggcaaacctgcatacaccatgacactggcggcaaaattggcacacgtcaaaggcgtgaaaaccctgtttttctgctgcgaacgcctgcccgacggacaaggcttcgtgttgcacatccgccccgtccaaggggaattgaacggcaacaaagcccacgatgccgccgtgttcaaccgcaataccgaatattggatacgccgttttccgacgcagtatctgtttatgtacaaccgctataaaacgccgtaa

SEQ ID NO: 40201 - protein, 297 aa, Neisseria gonorrhoeae
MFRLQFRLFPPLRTAMHILLTALLKCLSLLSLSCLHTLGNRLGHLAFYLLKEDRARIVANMRQAGLNPDTQTVKAVFAETAKCGLELAPAFFKKPEDIETMFKAVHGWEHVQQALDKGEGLLFITPHIGSYDLGGRYISQQLPFHLTAMYKPPKIKAIDKIMQAGRVRGKGKTAPTGIQGVKQIIKALRAGEATIILPDHVPSPQEGGGVWADFFGKPAYTMTLAAKLAHVKGVKTLFFCCERLPDGQGFVLHIRPVQGELNGNKAHDAAVFNRNTEYWIRRFPTQYLFMYNRYKTP

SEQ ID NO: 40202 - DNA, 866 bp, Neisseria meningitidis
ggcatgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgagcaaccatcgtcctgcccgaccacgtcccctcccctcaagaaggcggggaaggcgtatgggtggatttcttcggcaaacctgcctataccatgacgctggcggcaarattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcatatc

SEQ ID NO: 40203 - protein, 288 aa, Neisseria meningitidis
  misc_feature (228)..(228): Xaa can be any naturally occurring amino acid
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAXLAHVKGVKTLFFCCERLPGGQGFDLHIRPVQGELNGDKAHDAAVFNRNAEYWIRRFPTHI

SEQ ID NO: 40204 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcgtcaggcaggcatgaatcccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 40205 - protein, 298 aa, Neisseria meningitidis
MFRLQFRLFPPLRTAMHILLTALLKCLSLLPLSCLHTLGNRLGHLAFYLLKEDRARIVANMRQAGMNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 40206 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 40207 - protein, 298 aa, Neisseria meningitidis
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 40208 - DNA, 1563 bp, Neisseria gonorrhoeae
atggcggtatttgatgaagtcgggcgcatcgcccatggctgcggcggtgttgtcaaacaaagcctgtttctgcgcgtcgttcatcaggttgaacaaggcgcgcggttggctgaagtagtcgtcatcgtcttggcggtagtcccagtgtgccgcgtcgccgttgattttcaaaggcggttcggcgaagtcgggttgttgctgccattggccgaagctgttgggttcgtagtgcggcaggctgccgtagttgccgtcggcgcggccttgtccgtcgcgctggttgctgtgaacagggcaacgcggacgattgacggggatttggcggaagttcacacccaagcggtaacgttgcgcgtcggcgtaattgaacaaacgggcttgcaacattttatccgggctcgcgccgataccgggaacgaggttgctcggtgcgaaggcggattgttccacatcggcgaagaagttttcgggattgcggttcaactcgaattcgcccacttcaatcagcggatagtcttttttcggccaaactttggtcaagtcaaacggatgataaggcactttttcggcatcggcttcaggcatgacttggatgtacatcgtccatttcgggaactcgccgcgctcgatggcttcgtacaggtcgcgctgatggctttcgcggtcgtcggcgatgatttttgcagcttcttcgttggtcaggtttttaatcccttgctggctgcggaaatggaatttcacccaaaaacgttcgcccgcttcgttccagaagctgtaggtatgcgaaccgaagccgtgcatatggcggtagctggcgggaataccgcggtcgctcatcacgatggtaacttggtgcagggcttcgggcagcagcgtccagaagtcccagttgtttgtggcggaacgcatattggtgcgcggatcgcgtttgacggctttgttcaggtcggggaatttgcgcgggtcgcgcaggaagaacacgggcgtgttgttgccgaccacatcccagttgccttcttcggtatagaatttcaacgcaaaaccgcggatgtcgcgttccgcatcggctgcgccgcgctcgcctgccacggtggtgaaacgggcgaacatctcggtttttttgccgacttcgctgaaaattttggcgcgggtgtatttggtgatgtcgtgtgttacggtaaacgtaccgaacgcgcccgaacctttggcgtgcatacggcgttcggggatgacttcgcgcacgaagtcggcgagtttttcattcagccacaaatcttgcgtcagcagggggccgcgcgggccggcggtcaggctgttttgattgtcggcaacgggcgcgccgttgttcatggtcagatgggttacggggcatttggaggtagtcatcgctcttgttccttttctcaggttggtcaaatggggggcaaacggcttacagtacgatttggcggaaagcgtattcgtaaccggtttcttgattgtaataaatttcttgaatcgacattttattttccttttgcaaaaactatggatgcgattatacgccaagattttcgttattaa

SEQ ID NO: 40209 - protein, 520 aa, Neisseria gonorrhoeae
MAVFDEVGRIAHGCGGVVKQSLFLRVVHQVEQGARLAEVVVIVLAVVPVCRVAVDFQRRFGEVGLLLPLAEAVGFVVRQAAVVAVGAALSVALVAVNRATRTIDGDLAEVHTQAVTLRVGVIEQTGLQHFIRARADTGNEVARCEGGLFHIGEEVFGIAVQLEFAHFNQRIVFFRPNFGQVKRMIRHFFGIGFRHDLDVHRPFRELAALDGFVQVALMAFAVVGDDFCSFFVGQVFNPLLAAEMEFHPKTFARFVPEAVGMRTEAVHMAVAGGNTAVAHHDGNLVQGFGQQRPEVPVVCGGTHIGARIAFDGFVQVGEFARVAQEEHGRVVADHIPVAFFGIEFQRKTADVAFRIGCAALACHGGETGEHLGFFADFAENFGAGVFGDVVCYGKRTERARTFGVHTAFGDDFAHEVGEFFIQPQILRQQGAARAGGQAVLIVGNGRAVVHGQMGYGAFGGSHRSCSFSQVGQMGGKRLTVRFGGKRIRNRFLDCNKFLESTFYFPFAKTMDAIIRQDFRY

SEQ ID NO: 40210 - DNA, 1322 bp, Neisseria meningitidis
atggcggtatttgatgaagtcgggcgcgtcgcccattgcggcggcggtgttgccgaacaatgcctgtttctgcgcgtcgttcatcaggttgaacagggcgcgcggttggctgaaatagtcgtcatcgtcttggcggtagtcccagtgtgccgcgtcgccgttgattttcaaaggcggttcggcgaatcggggttgttgctgccattggccgaagctgtygggttcgtagtgcggcaggctgccgyagttgccgtcggcgcggccttgcccgtygcgstgrttgctgtgaacasggcaacgcggacgattgacgggaatttggcggaagtttacgcccaaacggtagcgttgtgcgtcggcgtaattgaacaaacgcgcttgcagcattttatctsggctggcgccgacaccgggaacgaggttgctcggtgcgaaggcggattgttccacatcggcgaagaagttttcgggattgcggttctcaaacggatgataaggtactttttccgcgtctgcttcaggcatgacttggatgtacatcgtccatttcggaaactcgccgcgttcgatggcttcstataagtcgcgctgatggctttcgcggtcgtcggcgatgattttggcggcttcttcgttggtcaggtttttaatgccttgttgggtgcggaaatggaatttcacccaaaaacgctcgcctgcttcgttccagaagctgtaggtatgcgaaccgaagccgtgcatatggcggtagccggcggggatgccgcggtcgctcatcacgatggtaacttggtgcagtgcttcgggcagcagcgtccagaagtcccagttgtttgtggcagagcgcatattggtgcgcgggtcgcgtttgacggctttgttcaggtcggggaacttacgcgggtcgcgcaggaagaacacgggcgtgttgttgccgaccacatcccagttgccttcttcggtataaaatttcaaggcaaaaccgcggatgtcgcgttctgcatcggctgcgccgcgttcgcctgccacggtggtgaaacgggcgaacatctcggtttttttgccgacttcgctgaagattcctttggcgtgcatacggcgttcggggatgacttcgcgcacgaagtcggcgagtttttcagtcatcgctcttgttccttttctcaggttggtcaaatgggggtaaacggcttacagtacgatttggcggaaagcgtattcgtaaccggtttcttgattgcaataaatttcttgaatcgacattttatttcccttttgtaaaaactatggatgcgactatacgccaagattttcgctattaa

SEQ ID NO: 40211 - protein, 520 aa, Neisseria meningitidis
  misc_feature (82)..(82): Xaa can be any naturally occurring amino acid
  misc_feature (93)..(94): Xaa can be any naturally occurring amino acid
  misc_feature (98)..(98): Xaa can be any naturally occurring amino acid
  misc_feature (132)..(132): Xaa can be any naturally occurring amino acid
  misc_feature (213)..(214): Xaa can be any naturally occurring amino acid
MAVFDEVGRVAHCGGGVAEQCLFLRVVHQVEQGARLAEIVVIVLAVVPVCRVAVDFQRRFGESGLLLPLAEAVGFVVRQAAXVAVGAALPVAXXAVNXATRTIDGNLAEVYAQTVALCVGVIEQTRLQHFIXAGADTGNEVARCEGGLFHIGEEVFGIAVQLEFAHFNQRIVFFRPNFGQVKRMIRYFFRVCFRHDLDVHRPFRKLAAFDGFXXVALMAFAVVGDDFGGFFVGQVFNALLGAEMEFHPKTLACFVPEAVGMRTEAVHMAVAGGDAAVAHHDGNLVQCFGQQRPEVPVVCGRAHIGARVAFDGFVQVGELTRVAQEEHGRVVADHIPVAFFGIKFQGKTADVAFCIGCAAFACHGGETGEHLGFFADFAEDFGAGVFGDVVRYGKRTERARTFGVHTAFGDDFAHEVGEFFIQPQILRQQRAARTGGQAVLIVGNRRAVVHGQMGYRAFGGSHRSCSFSQVGQMGGKRLTVRFGGKRIRNRFLDCNKFLESTFYFPFVKTMDATIRQDFRY

SEQ ID NO: 40212 - DNA, 1562 bp, Neisseria meningitidis
  misc_feature (1382)..(1382): n is a, c, g, or t
atggcggtatttgatgaagtcgggcgcgtcgcccattgcggcggcggtgttgccgaacaatgcctgtttctgcgcgtcgttcatcaggttgaacagggcgcgcggttggctgaaatagtcgtcatcgtcttggcggtagtcccagtgcgccgcgtcgccgttgattttcaaaggcggttcggcgaagtcgggctgctgctgccattggccgaagctgttgggttcgtagtgcggcaggctgccgtagttgccgtcggcgcgtccttgtccgtcgcgctggttgctgtgaacagggcaacgcggacggttgacagggatttggcggaagttcacgcccaagcggtagcgttgcgcgtcggcgtaattgaacaaacgcgcctgcaacattttatctgggctggcgccgacaccgggaacgaggttgctcggtgcgaaggcggattgttccacatcggcgaagaagttttcgggattgcggttcaactcgaattcgcccacttcaatcagcggatagtcttttttcggccaaactttggtcaagtcaaacggatgatacggcactttttccgcatcggcttcaggcatgacttggatgtacatcgtccatttcggaaactcgccgcgctcgatggcttcgtacaggtcgcgctgatggctttcacggtcgtcggcgatgattttggcggcttcttcgttggtcaggtttttaatgccttgttgggtgcggaaatggaatttcacccaaaaacgctcgcctgcttcgttccagaagctgtaggtatgcgaaccgaagccgtgcatatggcggtagccggcggggatgccgcggtcgctcatcacgatggtaacttggtgcagtgcttcgggcagcagcgtccagaagtcccagttgtttgtggcagagcgcatattggtgcgcgggtcgcgtttgacggctttgttcaggtcggggaacttacgcgggtcgcgcaggaagaacacgggcgtgttgttgccgaccacatcccagttgccttcttcggtatagaacttcaacgcaaaaccgcggatgtcgcgttctgcatcggctgcgccgcgttcgcctgccacggtggtgaaacgggcgaacatctcggtttttttgccgacttcgctgaagattttggcgcgggtgtatttggtgatgtcgtgcgttacggtaaacgtaccgaacgcgcccgaacctttggcgtgcatacggcgttcggggatgacttcgcgcacgaagtcggcgagtttttcattcagccacaaatcctgcgccagcagagggccgcgaggaccggcggtcaggctgttttgattgtcggcaacaggcgcgccgttgttcatggtcagatgggttacagggcatttggaggtantcatcgctcttgttccttttctcaggttggtcaaatgggggtaaacggcttacagtacgatttggcggaaagcgtattcgtaaccggtttcttgattgcaataaatttcttgaatcgacattttatttcccttttgtaaaaactatggatgcgactatacgccaagattttcgctattaa

SEQ ID NO: 40213 - protein, 520 aa, Neisseria meningitidis
  misc_feature (461)..(461): Xaa can be any naturally occurring amino acid
  misc_feature (473)..(473): Xaa can be any naturally occurring amino acid
MAVFDEVGRVAHCGGGVAEQCLFLRVVHQVEQGARLAEIVVIVLAVVPVRRVAVDFQRRFGEVGLLLPLAEAVGFVVRQAAVVAVGASLSVALVAVNRATRTVDRDLAEVHAQAVALRVGVIEQTRLQHFIWAGADTGNEVARCEGGLFHIGEEVFGIAVQLEFAHFNQRIVFFRPNFGQVKRMIRHFFRIGFRHDLDVHRPFRKLAALDGFVQVALMAFTVVGDDFGGFFVGQVFNALLGAEMEFHPKTLACFVPEAVGMRTEAVHMAVAGGDAAVAHHDGNLVQCFGQQRPEVPVVCGRAHIGARVAFDGFVQVGELTRVAQEEHGRVVADHIPVAFFGIELQRKTADVAFCIGCAAFACHGGETGEHLGFFADFAEDFGAGVFGDVVRYGKRTERARTFGVHTAFGDDFAHEVGEFFIQPQILRQQRAARTGGQAVLIVGNRRAVVHGQMGYRAFGGXHRSCSFSQVGQXGGKRLTVRFGGKRIRNRFLDCNKFLESTFYFPFVKTMDATIRQDFRY

SEQ ID NO: 40214 - DNA, 558 bp, Neisseria gonorrhoeae
atgctcttgccggctttgcaacaaggcggcggcttcctgagcggcggcggtttcggcctcgtcgggcaggttcagggcttggttttcctgcttcagacggcctttgcgctcttcgtgcttggcaacggtttgttcggcatgggcaagctgctgctgcttcaacgccagttcgcggcggatgcggtttgcctcgtcctgctgggtttggaaggcagcgttgagcgtggcttggacttcttccaattcgggcagacgctcttcgtgttcggcaacctgcatcgcccattccgccaattcggtttgcttttcttcgacctgcaactcgttttcctcaagctgcacgcggatttgctgctgctcctgccggatgcgttgcaactgcgcctgcgctgcctgcttgtcgcgttcgatgcgttggtgcaggttttgccggtggcggatttgttcttccaaacgggcaatctgctcgcgcaacacgccgcgtttgttgctcaattcgtgtactgcctgctgctgcgactgttcggcagtctgcaaggcgtgtacttcgttatttaa

SEQ ID NO: 40215 - protein, 185 aa, Neisseria gonorrhoeae
MLLPALQQGGGFLSGGGFGLVGQVQGLVFLLQTAFALFVLGNGLFGMGKLLLLQRQFAADAVCLVLLGLEGSVERGLDFFQFGQTLFVFGNLHRPFRQFGLLFFDLQLVFLKLHADLLLLLPDALQLRLRCLLVAFDALVQVLPVADLFFQTGNLLAQHAAFVAQFVYCLLLRLFGSLQGVYFVI

SEQ ID NO: 40216 - DNA, 558 bp, Neisseria meningitidis
atgctcttgctgactttgcaacaaggcggctgcttcctgcgcggcggcggtttcggcttcgtcgggcaggtttaaggcttggttttcctgtttcagacgacctttgcgctcttcgtgcttggcaatcgtttgttcggcatgggcaagctgctgctgcttcaacgccagttcgcggcggatgcggtttgcctcgtcctgctgggtttggaaggcggcgttgagcgtggcttgggcttcttccaattcgggcagacgctcctcgtgttcggcaacctgcatcgcccattccgccagctcggtttgtttttcttcgacctgcaactcgttttcttcaagctgcacgcggatttgctgctgctcttgatgaatgcgttgtaactgcgcctgcgctgcctgcttgtcgcgttcgatgcgttggtgcaggttttgctgatggcggatttgttcttccaaacgggcaatctgctcgcgcaacacgccgcgcttgttgctcaattcatgcactgcctgctgctgcgactgttcggcagtctgcaaggcgtgtacttcgtcgtttaa

SEQ ID NO: 40217 - protein, 185 aa, Neisseria meningitidis
  misc_feature (25)..(25): Xaa can be any naturally occurring amino acid
  misc_feature (126)..(126): Xaa can be any naturally occurring amino acid
MLLLTLQQGGCFLRGGGFGFVGQVXGLVFLFQTTFALFVLGNRLFGMGKLLLLQRQFAADAVCLVLLGLEGGVERGLGFFQFGQTLLVFGNLHRPFRQLGLFFFDLQLVFFKLHADLLLLLMNALXLRLRCLLVAFDALVQVLLMADLFFQTGNLLAQHAALVAQFMHCLLLRLFGSLQGVYFVV

SEQ ID NO: 40218 - DNA, 558 bp, Neisseria meningitidis
atgctcttgctggctttgcaacaaggcggcagcttcctgcgcggcggcggtttcggcttcgtcaggcagattcagggcttggttttcctgtttcagacgacctttgcgctcttcgtgcttggcaacggtttgttcggcatgggcaagctgctgctgcttcaacgccagttcgcggcggatgcggtttgcctcgtcctgctgggtttggaaggcggcattgagtgtggcttgggtttcttccaattcgggcagacgctcttcgtgttcggcaacctgcatcgcccattccgccaattcggtttgcttttcttccgcctgcaactcgttttcttcaagctgcacgcggatttgctgctgctcctgatggatgcgctgcatctgcgcctgcgccgcctgcttgtcgcgttcgatgcgttggtgcaggttttgctgatggcggatttgttcttccaaacgggcaatctgttcgcgcaacacgccgcgtttgttgcccaattcgtgcaccgcctgctgctgcgactgttcggcagtctgcaaggcgtgtacttcgtcgtttaa

SEQ ID NO: 40219 - protein, 185 aa, Neisseria meningitidis
MLLLALQQGGSFLRGGGFGFVRQIQGLVFLFQTTFALFVLGNGLFGMGKLLLLQRQFAADAVCLVLLGLEGGIECGLGFFQFGQTLFVFGNLHRPFRQFGLLFFRLQLVFFKLHADLLLLLMDALHLRLRRLLVAFDALVQVLLMADLFFQTGNLFAQHAAFVAQFVHRLLLRLFGSLQGVYFVV

SEQ ID NO: 40220 - DNA, 504 bp, Neisseria gonorrhoeae
atggtagcgtttggcgttgatcagggcctcctgctgctgcaacagggcggtttgggtggcggcctgaagctgcggcagcttggtttgcagggtttgtacgcgggcgtattgctccctgccctgttcctgaatctgcgcgagtttttcctgcacggcgatgtattcttcgtccagcgtgtgtacggtttcggtcaactcgtcgagcttgatgtgctgctcgtcgttttggaactcggtttcataggcgagggcaagctcttgccggcgttcctgccagtccagggtttgctgttcgagccgggcgatttgctgccggtagttttgtttttgcgggttgagtttgtggacggcgacttcggcaagcccgtattggcggttggcttccaacagggcaagctgcgcctgtttcagacggccttgctgctcttggcggctgtgcgcggtggtttgctgctggtgttcgagttcggcggcggcttcctgcaaagtagcgatgtcgtctga

SEQ ID NO: 40221 - protein, 167 aa, Neisseria gonorrhoeae
MVAFGVDQGLLLLQQGGLGGGLKLRQLGLQGLYAGVLLPALFLNLREFFLHGDVFFVQRVYGFGQLVELDVLLVVLELGFIGEGKLLPAFLPVQGLLFEPGDLLPVVLFLRVEFVDGDFGKPVLAVGFQQGKLRLFQTALLLLAAVRGGLLLVFEFGGGFLQSSDVV

SEQ ID NO: 40222 - DNA, 504 bp, Neisseria meningitidis
atggtagcgtttggcgttgatcagggcttcctgctgctgcaacaaggcggtttgggtggcggcctgaagctgcggcagcttggtttgcagggtttgcactttagcgtattgctccctgccctgttcctgaatctgcgcgagtttctcttgcacaacaatatattcttcgtccaaggtctgtacggcttcgcttaattcttcaagcttgatgtgctgctcgtcgttttggaactcggtttcataggcgagggcaagctcttgctggcgttcctgccagtcgagggtttgctgttcaagctgggcgatttgctgccggtagttttgtttttgctggttgagtttgtggacggcgacttcggcaagcccgtattggcggttggcttccaacagggcaagctgcgcctgtttcagacggccttgctgctcttggcggctgtgcgcggtggtttgctgctggtgttcgagttcggcggcggcttcctgcaaggtaacgatgtcgtctga

SEQ ID NO: 40223 - protein, 167 aa, Neisseria meningitidis
  misc_feature (65)..(65): Xaa can be any naturally occurring amino acid
MVAFGVDQGFLLLQQGGLGGGLKLRQLGLQGLHFSVLLPALFLNLREFLLHNNIFFVQGLYGFAXFFKLDVLLVVLELGFIGEGKLLLAFLPVEGLLFKLGDLLPVVLFLLVEFVDGDFGKPVLAVGFQQGKLRLFQTALLLLAAVRGGLLLVFEFGGGFLQGNDVV

SEQ ID NO: 40224 - DNA, 504 bp, Neisseria meningitidis
atggtagcgtttggcgttgatcagggcttcctgctgctgcaacagggcggtttgggtggcggcctgaagctgcggcagcttggtttgcagggtttgtacgcgggcgtattgttccctaccctgctcctgaatctgcgcgagtttctcctgtacgacaatatattcttcgtccaaactctgtacggcttcgctcaactcttcgagcttgatgtgctgctcgtcgttttggaactcggtttcataggcgagggcaagctcttgctggcgttcctgccaatcgaaggtttgttgttcaagctgggcaatttgctgttggtagttttgtttttgctggttgagcttgtggacggcgacttcggcaagcccgtattggcggttggcttccaacagggcaagctgcgcctgtttcagacgaccttgctgctcttggcggctgtgcgcggcggtttgctgctggtgttcgagttcggcggcggcttcctgcaaaatggcgatgtcgtctga

SEQ ID NO: 40225 - protein, 167 aa, Neisseria meningitidis
MVAFGVDQGFLLLQQGGLGGGLKLRQLGLQGLYAGVLFPTLLLNLREFLLYDNIFFVQTLYGFAQLFELDVLLVVLELGFIGEGKLLLAFLPIEGLLFKLGNLLLVVLFLLVELVDGDFGKPVLAVGFQQGKLRLFQTTLLLLAAVRGGLLLVFEFGGGFLQNGDVV

SEQ ID NO: 40226 - DNA, 1725 bp, Neisseria gonorrhoeae
atggtcgctgtatgtgatgaacgggctgtacagcggacgttggtggcccaattcgcgcaacaaggcggcttgtttttgctcttcgttcaggctgttgtagtcttccaagcctgcgtgttggaaaagctcggcaaccacatcggcgtgtttgcctgcgtgttggcgcaggtcgagcggcatcatgtggaagccgaacacggacacggaacggatgaggtctgccaaacggccttcggcaagcaggcggctgccgttgtcgataagggaacgttgcaattttttcaaatcatcgagaaatttttgggccgaagcataaggctcgagaaagccgaatttgcagcccatgcccaaaccgagcgagcgcgctttgcccatagcgcgcgccataatgtaggcaatggcgcggcggtaaggttcttcggtgcgggcgatttcttcgtcaggcgagagggctgccagtgccattacgtcgtcgttgactttgacgcggcggatggaaagcggcagttcgcggtaaagtttgtcgagttcgctgcggtaaaaacggaacacggcatcggcgtggcggcggaaggcaaagcgcagggtttcgccagaaacaaacggattgccgtcgcggtcgccgccgatccagccgccgattttaaggatattcggaacgcggacatcgggataggccgtctgaaagtcgtgttccatcttgcggtagagtttgggcagggcttcaaaaaagctcatcgggaagatggacacgccgttgttgatttcgtcgttgacgctgagtttgtggcggcgcgtttcgctggtctgccacaagcccagaagcacggtgtcgatttcgcggcgcagccgtgccagcgcgtcggcattggtgcagcgttcgcgttgcggcagcagcgcgcggatgcggcggttgaaattcaaaacggtttggcgttgcacttcggtcgggtgcgcggtcaaaacggcggtaacggacgtattgtccaactgccgctgcaccgatttgccgtcggctttccccgctttgagcctgcggacggtttccgtcaggctgccttctgctgcgttgtggccggcatcttcgtggatttggcggcggcgttcgtggtgcacgtcttcggcgatattcagaatctgggcgaacagcccgcaggcaagcgtcagatcgtaggtctgccgttcgtccaattgcggcaatactttttcaatcaatgccgcgctgtcgtcggaagtggacaagagtttgaccgtttcgacaaccaacggcgaggcttcttcgtgcaggaggttgaacagggactgtttcaaaaattccgcgtccgccgccaaagccgcgtccttcggattgttcaggatatgcagttgcatgattttcctctcattgccgtaaatactgtaaatgtacctcaaatgccgcatccgtgccaaaccgttcacactttaaccactcatgtcccgaaatgccgtctgaagttgaacgccgcccgacggcggcgttacaatcgcccgcaactgtttttttccgaacatcatcatgaccgcgaccgaacacgacaacgacgacgcactcctgctgcggtacagccgccacatcctcttggacgaaatcggcatcgaagggcagcagaagctttccgccgcgcatattttggtcgtcggctgcggcggattgggcgccgccgcccctgccctatctcgccgcctcgggggtcggcacgctga

SEQ ID NO: 40227 - protein, 574 aa, Neisseria gonorrhoeae
MVAVCDERAVQRTLVAQFAQQGGLFLLFVQAVVVFQACVLEKLGNHIGVFACVLAQVERHHVEAEHGHGTDEVCQTAFGKQAAAVVDKGTLQFFQIIEKFLGRSIRLEKAEFAAHAQTERARFAHSARHNVGNGAAVRFFGAGDFFVRREGCQCHYVVVDFDAADGKRQFAVKFVEFAAVKTEHGIGVAAEGKAQGFARNKRIAVAVAADPAADFKDIRNADIGIGRLKVVFHLAVEFGQGFKKAHREDGHAVVDFVVDAEFVAARFAGLPQAQKHGVDFAAQPCQRVGIGAAFALRQQRADAAVEIQNGLALHFGRVRGQNGGNGRIVQLPLHRFAVGFPRFEPADGFRQAAFCCVVAGIFVDLAAAFVVHVFGDIQNLGEQPAGKRQIVGLPFVQLRQYFFNQCRAVVGSGQEFDRFDNQRRGFFVQEVEQGLFQKFRVRRQSRVLRIVQDMQLHDFPLIAVNTVNVPQMPHPCQTVHTLTTHVPKCRLKLNAARRRRYNRPQLFFSEHHHDRDRTRQRRRTPAAVQPPHPLGRNRHRRAAEAFRRAYFGRRLRRIGRRRPCPISPPRGSAR

SEQ ID NO: 40228 - DNA, 1727 bp, Neisseria meningitidis
atggtcgctgtatgtgataaacgggctgtacagaggacgttgatggctcaattcgcgcaacagggcggtttgtttttgctcttcgttcaggcggttgtagtcttccaagcctgcgtgttggaaaagctcggcaaccacatcggcgtgtttgcctgcgtgttggcgcaagtcgagcggcatcatgtgaaagccgaacacggatacggaacggatgaggtctgccaaacggccttcggcaagcagacggctgccgttgtcgataagggaacgttgcaattttttcaaatcatccagaaactcttgtgccgaagcataaggctcgagaaagccgaatttgcagcccatacccaaaccgagcgcgcgcgctttgcccatagcgcgcgccataatgtaggcgatggcgcggcggtagggttcttcggcgcgggcgatttcttcgtcgggcgatttgtcggacaacgccgttacatcgccgttgactttgacgcggcggatggagagcggcagttcgcggtagagtttgtcgagttcgccgcgatagaagcggaacacggcatcggcgtggcggcggaaggcaaagcgcagggtttcggcagaaacaaacggattgccgtcgcggtcgccgccgatccagccgccgattttgaggatgtccggaacgcggacgccgggataggccgtctgaaagtcgtgttccatcttgcggtagagcttgggcagggcttcgaaaaagctcatcgggaagatggacacgccgttgttgatttcgtcgttgacgctgagtttgtggcggcgcgtttcgctggtctgccacaagcccagcaggatagtgtcgatttcgcggcgcagccgtgccagcgcgtcggcattggtgcagcgttcgcgttgcggcaacagtgcgcggatgcggcggttgaagcttaagacggtttggcgttgcacttcggtcgggtgcgcggtcaaaacggcggtaacggacgtattgtccaactgccgctgcaccgatttgccgtcggctttccccgctttgagcctgcggacggtttccgtcaggctgccttccgcgccgccgcgtccggcttcttcgtggatttggcggcggcgttcgtggtgcacgtcttcggcgatgttcaaaatctgggcgaacaggccgcaggccaaggttaaatcgtgggtttgttgttcgtccaattgcggcaatactttttcaatcaatgccgcgctgtcgtcggaagtggacaagagtttgactgtttcgacaaccaacggcgaggcttcttcgtgcaggaggttgaacagggattgtttcagaaattccgcgtccgccgccaaagccgcgtcctttggattgttcagaatatgcagttgcatgatttttctctctcgtctgccgtaaatattgtaaatgtaccccaaatgccgcatccgtgccaaaccgttcacactttaaccgcccgtgtcccgaaatgccgtctgaagttgaacgccgcccgacggcagcgttacaatcgcccgcaactgtttttttccgaacatcatcatgaccacgaccgaacacgacaacgacgatgcattcctgctgcggtacagccgccacatcctcttggacgaaatcggcatcgaagggcagcagaaactttccgccgcgcatattttggtcgtcggctgcggcggtttgggtgccgccgcactgccctaccttgccgcttcgggtgtcggcacgctga

SEQ ID NO: 40229 - protein, 575 aa, Neisseria meningitidis
  misc_feature (308)..(308): Xaa can be any naturally occurring amino acid
  misc_feature (389)..(389): Xaa can be any naturally occurring amino acid
  misc_feature (565)..(565): Xaa can be any naturally occurring amino acid
MVAVCDKRAVQRTLMAQFAQQGGLFLLFVQAVVVFQACVLEKLGNHIGVFACVLAQVERHHVKAEHGYGTDEVCQTAFGKQTAAVVDKGTLQFFQIIQKLLCRSIRLEKAEFAAHTQTERARFAHSARHNVGDGAAVGFFGAGDFFVGRFVGQRRYIAVDFDAADGERQFAVEFVEFAAIEAEHGIGVAAEGKAQGFGRNKRIAVAVAADPAADFEDVRNADAGIGRLKVVFHLAVELGQGFEKAHREDGHAVVDFVVDAEFVAARFAGLPQAQQDSVDFAAQPCQRVGIGAAFALRQQCADAAVEAXDGLALHFGRVRGQNGGNGRIVQLPLHRFAVGFPRFEPADGFRQAAFRAAASGFFVDLAAAFVVHVFGDVQNLGEQAAGQGXIVGLLFVQLRQYFFNQCRAVVGSGQEFDCFDNQRRGFFVQEVEQGLFQKFRVRRQSRVLWIVQNMQLHDFSLSSAVNIVNVPQMPHPCQTVHTLTARVPKCRLKLNAARRQRYNRPQLFFSEHHHDHDRTRQRRCIPAAVQPPHPLGRNRHRRAAETFRRAYFGRRLRRFGCRRTXPTLPLRVSAR

SEQ ID NO: 40230 - DNA, 1723 bp, Neisseria meningitidis
atggtcgctgtatgtgatgaacggactgtacagtggacgttgatggctcaattcgcgcaacagggcggcttgtttttgctcttcgttgaggctgttgtagtcttccaagcctgcgtgttggaaaagctcggcaaccacatcggcgtgtttgcctgcgtgttggcgcaggtcgagcggcatcatgtggaagccgaacacggatacggaacggatgaggtctgccaaacggccttcggcaagcaggcggctgccgttgtcgataagggaatgttgcaattttttcaaatcatcgagaaattcttgtgccgaagcataaggctcgagaaagccgaatttgcagcccatacccaaaccgagcgcgcgcgctttgcccatagcgcgcgccataatgtaggcaatggcgcgacggtagggttcttcggcgcgggcggtttcttcgtcgggcgatttgtcggacaacgccatcacatcgccgttgactttgacgcggcggatggagagcggcagttcgcggtagagtttgtcgagttcgccacggtaaaaacggaacacggcatcggcgtggcggcggaaggcaaaacgcaaggtttcggcagaaacgaacggattgccgtcgcggtcgccgccgatccagccgccgattttgaggatgtccggaacgcggacatcgggataggccgtctgaaagtcgtgttccatcttgcggtagagcttgggcagggcttcaaaaaagctcatcggaaagatggacacgccgttgttgatttcgtcgttgacgctgagtttgtggcggcgcgtttcgctggtctgccacaagcccagcaggatagtgtcgatttcgcggcgcagccgtgccagcgcgtcggcattggtacagcgttcgcgttgcggcagcagcgcgcggatgcggcggttgaaattcaagacggtctggcgttgcacttcggtcgggtgcgcggtcaaaacggcggtaacggacgtattgtccaactgccgctgcaccgatttgccgtcggctttccccgctttgagcctgcggacggtttccgtcaggctgccttccgcgccgccgcgtccggcttcttcgtggatttggcggcggcgttcgtggtgcacgtcttcggcgatgttcaaaatctgggcgaacaggccgcaggccaaggttaaatcgtgggtttgttgttcgtccaattgcggcaatactttttcaatcaatgccgcgctgtcgtcggaagtggacaagagtttgaccgtttcgacaaccaacggcgaggcttcttcgtgcaggaggttgaacagggattgtttcagaaattccgcgtccgccgccaaagccgcgtcctttggattgttcagaatatgcagttgcatgatttttctctcattgccgtaaatactgtaaatgtacctcaaatgccgcatccgtgccaaaccgttcacactttaaccgcccgtgtcccgaaatgccgtctgaagttgaacgccgcccgacggcagcgttacaatcgcccacaactgttttttccgaacatcatcatgaccacgaccgaacacgacaacgacgatgcattcctgctgcggtacagccgccacatcctcttggacgaaattggcatcgaagggcagcagaaactttccgccgcgcatattttggtcgtcggctgcggcggtttgggtgccgccgccctgccctatctcgccgcttccggcatcggcacgctga

SEQ ID NO: 40231 - protein, 573 aa, Neisseria meningitidis
  misc_feature (507)..(507): Xaa can be any naturally occurring amino acid
  misc_feature (561)..(561): Xaa can be any naturally occurring amino acid
MVAVCDERTVQWTLMAQFAQQGGLFLLFVEAVVVFQACVLEKLGNHIGVFACVLAQVERHHVEAEHGYGTDEVCQTAFGKQAAAVVDKGMLQFFQIIEKFLCRSIRLEKAEFAAHTQTERARFAHSARHNVGNGATVGFFGAGGFFVGRFVGQRHHIAVDFDAADGERQFAVEFVEFATVKTEHGIGVAAEGKTQGFGRNERIAVAVAADPAADFEDVRNADIGIGRLKVVFHLAVELGQGFKKAHRKDGHAVVDFVVDAEFVAARFAGLPQAQQDSVDFAAQPCQRVGIGTAFALRQQRADAAVEIQDGLALHFGRVRGQNGGNGRIVQLPLHRFAVGFPRFEPADGFRQAAFRAAASGFFVDLAAAFVVHVFGDVQNLGEQAAGQGIVGLLFVQLRQYFFNQCRAVVGSGQEFDRFDNQRRGFFVQEVEQGLFQKFRVRRQSRVLWIVQNMQLHDFSLIAVNTVNVPQMPHPCQTVHTLTARVPKCRLKLNAARRQRYNRPQLFXSEHHHDHDRTRQRRCIPAAVQPPHPLGRNWHRRAAETFRRAYFGRRLRRFGCRXPCPISPLPASAR

SEQ ID NO: 40232 - DNA, 399 bp, Neisseria gonorrhoeae
atgccttcgcggacaccgcagggaaaaaggggttattcctgccccaagcgggatagtgccttttggcaggcgttgtccatatcggttattttacgcgcaaaatcgccgattgccaaatcgccgccgttcagggaggttttcaataggtcgtggacgacgttgagcgcggccataatgacgattttttcgctgtccgcgacgcggccgccttcgcggatggcttcggctttgccgttgagcattccgactgcctgcaacagtgtgtctttttcttctgccggcgtgttgacagtcagccggggcgtgcatgacttcgatgtagacttgttcgatgttcatcctttaatccttattgctgcgtttcctgccgttgggggaggcgcgctgccagtgcgctga

SEQ ID NO: 40233 - protein, 132 aa, Neisseria gonorrhoeae
MPSRTPQGKRGYSCPKRDSAFWQALSISVILRAKSPIAKSPPFREVFNRSWTTLSAAIMTIFSLSATRPPSRMASALPLSIPTACNSVSFSSAGVLTVSRGVHDFDVDLFDVHPLILIAAFPAVGGGALPVR

SEQ ID NO: 40234 - DNA, 399 bp, Neisseria meningitidis
  misc_feature (24)..(24): n is a, c, g, or t
atgccttcgcggacaccgcagggnaaaaggggttattcctgcgccaagcgggatagtgctttttggcaggcgttgtccatatcggctattttacgcgcaaaatcgccgattgccaaatcgccgccgttcagggaggttttcaacaggtcgtggacgacgttgagcgcggccataatgacgattttttcgctgtccgcgacgcgtccgccttcgcggatggcttcggctttgccgttgagcattccgactgcctgcaacagtgtgtctttttcttctgccggcgtgttgacggtcagccggggcgtgcawgacttcsatgtggacttgttcgatgttcatcctttaatccttattgctgcgtttcctgccattgggggaggcgcgctgccagtgcgctga

SEQ ID NO: 40235 - protein, 132 aa, Neisseria meningitidis
  misc_feature (103)..(103): Xaa can be any naturally occurring amino acid
  misc_feature (106)..(106): Xaa can be any naturally occurring amino acid
MPSRTPQGKRGYSCAKRDSAFWQALSISAILRAKSPIAKSPPFREVFNRSWTTLSAAIMTIFSLSATRPPSRMASALPLSIPTACNSVSFSSAGVLTVSRGVXDFXVDLFDVHPLILIAAFPAIGGGALPVR

SEQ ID NO: 40236 - DNA, 398 bp, Neisseria meningitidis
atgccttcgcggacaccgcagggaaaaaggggttattcctgcgccaagcgggatagtgctttttggcaggcgttgtccatatcggctattttacgcgcaaaatcgccgattgccaaatcgccgccgttcagggaggttttcaacaggtcgtggacgacgttgagcgcggccataatgacgattttttcgctgtccgcgacgcgtccgccttcgcggatggcttcggctttgccgttgagcattccgactgcctgcaacagtgtgtctttttcttctgccggcgtgttgacggtcagccgggcgtgcatgacttcgatgtggacttgttcgatgttcatcctttaatccttattgctgcgtttcctgccgttgggggaggcgcgctgccagtgcgctga

SEQ ID NO: 40237 - protein, 132 aa, Neisseria meningitidis
  misc_feature (101)..(101): Xaa can be any naturally occurring amino acid
MPSRTPQGKRGYSCAKRDSAFWQALSISAILRAKSPIAKSPPFREVFNRSWTTLSAAIMTIFSLSATRPPSRMASALPLSIPTACNSVSFSSAGVLTVSRXVHDFDVDLFDVHPLILIAAFPAVGGGALPVR

SEQ ID NO: 40238 - DNA, 834 bp, Neisseria meningitidis
atgaaagtgcttgttttaggtgcgggtgttgccggcgtatcctccgtgtggtatctggcagaggccggacatgaagtaacggtcatcgaccgcaccgagggtgtggcgatggaaaccagttttgccaatgcaggccagctttcttacggctataccacgccttgggctgcacccggtattccgaccaaagcactgaaacggctgtttaaaagccatccgcctttactgttccgccctgacggcggcctgtatcaaatcgaatggctgtggcggatgctgcaaaactgcacggcaacgcgctatcaaatcaataaagagcgcatggtcaggatttccgaatacagccgtgaaatgttccgccgttttgaagcgcaaaccgacatgaattttgagggacgcaaaaaagggacgttgcagattttccgccaaaccgaagaagtcgaagcggcaaaacaagacattgccgttttggaacgctacggcgtgccgtaccgccgtctgaagcccgaagaatgcgcagaattcgagcctgcgctggcacgcgttaccgccaaaattgtcggcggtctgcacctgcctgcggatgcgaccggcgactgccgcctcttcaccgaaaacctgtacaaattgtgtcaagagaagggggtacggttctacttcaaccaaaccatcagccgcatcgaccacaacgggctgcgcatcaaagccgttgaaacgaaacagggcggtttgaaacagatgccgttgtctgcgcgctcggctgcttcagcaggactgtgttggcgcagttggatctcaatctgcccatttatcccgtcaaaggctattccttga

SEQ ID NO: 40239 - protein, 277 aa, Neisseria meningitidis
MKVLVLGAGVAGVSSVWYLAEAGHEVTVIDRTEGVAMETSFANAGQLSYGYTTPWAAPGIPTKALKRLFKSHPPLLFRPDGGLYQIEWLWRMLQNCTATRYQINKERMVRISEYSREMFRRFEAQTDMNFEGRKKGTLQIFRQTEEVEAAKQDIAVLERYGVPYRRLKPEECAEFEPALARVTAKIVGGLHLPADATGDCRLFTENLYKLCQEKGVRFYFNQTISRIDHNGLRIKAVETKQGGLKQMPLSARSAASAGLCWRSWISICPFIPSKAIP

SEQ ID NO: 40240 - DNA, 369 bp, Neisseria meningitidis
gttttggaacgctacggcgtgccgtaccgccgtctgaaacccgaagaatgtgcagaatttgagcctgcgctggcacgcgttaccgccaaaattgccggcggcctgcacctgcctgcagatgcgaccggcgactggcgcctcttcactgaaaacctatacaaattgtgtcaggaaaagggcgtacggtttcatttcaaccaaaacatcagccgcatcgaccacaacgggctgcgcatcaaaaccgttgaaaccaaacagggcggtttgaagcagatgccgttgtctgcgcgctcggttgcttcagcaggacggttttggcgcagttggatctcaatctgcccatttatcccgtcaaaggctattccttga

SEQ ID NO: 40241 - protein, 122 aa, Neisseria meningitidis
VLERYGVPYRRLKPEECAEFEPALARVTAKIAGGLHLPADATGDWRLFTENLYKLCQEKGVRFHFNQNISRIDHNGLRIKTVETKQGGLKQMPLSARSVASAGRFWRSWISICPFIPSKAIP

SEQ ID NO: 40242 - DNA, 834 bp, Neisseria meningitidis
atgaaagtgcttgttttaggtgctggtgttgccggcgtatcttccgcgtggtatctggcagaggcaggacatgaagtaacggtcatcgaccgcgccgagggcgtggcgatggaaaccagttttgccaacgcaggccagctttcttacggctataccacgccttgggctgcacccggtattccgaccaaagcactgaaatggctgtttaaaagccatccgcctttgctgtttcgccccgacggcagcctgtatcaaatcgaatggctgtggcagatgctgcaacactgcacggcagcgcgctatcaaatcaataaagagcgcatggtcaggatgtccgaatacagccgtgaaatgttccgccgttttgaagcgcaaaccggcatgaattttgagggacgcaaaaaagggacgttgcagattttccgccaaaccaaagaagtcgaagcggcaaaacaagacattgccgttttggaacgctacggcgtgccgtaccgccgtctgaagcccgaagaatgcgcagaattcgagcctgcgctggcacgcgttaccgccaaaattgccggcggcctgcacctgcccgcagacgcgaccggcgactgccgcctcttcactgaaaacctgtacaaattgtgtcaggaaaagggcgtacggtttcatttcaaccaaaccatcagccgcatcgaccacaacgggctgcgcatcaaaaccgttgaaacgaaacagggcggtttgaagcagatgccgttgtctgcgcgctcggctgcttcagcaggacggttttggcgcaagtggatctcaatctgccgatttatcccgtcaaaggctattccttga

SEQ ID NO: 40243 - protein, 277 aa, Neisseria meningitidis
MKVLVLGAGVAGVSSAWYLAEAGHEVTVIDRAEGVAMETSFANAGQLSYGYTTPWAAPGIPTKALKWLFKSHPPLLFRPDGSLYQIEWLWQMLQHCTAARYQINKERMVRMSEYSREMFRRFEAQTGMNFEGRKKGTLQIFRQTKEVEAAKQDIAVLERYGVPYRRLKPEECAEFEPALARVTAKIAGGLHLPADATGDCRLFTENLYKLCQEKGVRFHFNQTISRIDHNGLRIKTVETKQGGLKQMPLSARSAASAGRFWRKWISICRFIPSKAIP

SEQ ID NO: 40244 - DNA, 576 bp, Neisseria gonorrhoeae
atgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttatggcgatttgagcggtgcggcgctgacgcaggcggcgattgtcagccaagtggggcaatggggcgcgggtttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcatcatggcgtggatcaacctcgtcgccatcctgctgctctcgccattggcgtttatgctgctgcgcgattacaccgccaagctgaaaatgggcaaagaccccgagttcaaactttccgaacatccgggcctgaaacgccgcatcaaatccgatgtttggtaa

SEQ ID NO: 40245 - protein, 191 aa, Neisseria gonorrhoeae
MGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 40246 - DNA, 576 bp, Neisseria meningitidis; identical to SEQ ID NO: 40244

SEQ ID NO: 40247 - protein, 191 aa, Neisseria meningitidis; identical to SEQ ID NO: 40245

SEQ ID NO: 40248 - DNA, 1428 bp, Neisseria meningitidis
  misc_feature (79)..(79): n is a, c, g, or t
atgaacgagaactttaccgaatggctgcacggctgggtcggcgccatcaacgatccgatgtggtcatacttggtttatntgcttttgggtacggggcttttcttcaccgtaaccacgggctttgtccaattccgcctgttcgggcgcagcatcaaagaaatgctcggcggccgcaaacagggggacgaccctcacggcatcacgccgtttcaggcatttgtaaccggccttgccagccgcgtgggcgtgggcaatatcgcgggcgtggccatcgccatcaaagtcggcggaccgggcgcggtgttttggatgtgggtaaccgccttaatcggtatgagttcggcgtttgtcgaatcttcgctggcgcagctctttaaagtccgcgactacgacaaccaccatttccggggcggccctgcctactacatcactcaagggctggggcagaaatggctgggcgtgttgttcgccctgagcctgattttctgtttcggctttgtgtttgaagcggttcagaccaataccattgccgataccgtcaaagcggcgtggggttgggagcctcattatgtcggcgtcgccctggtgattttaaccgcgccgattatcttcggcggcatcaggcgcatatctaaagcggcggaaatcgtcgtccccctgatggcggttttgtacctctttatcgcgcttttcatcattttgaccaatattccgatgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttacggcgatttgagcggtgcggcgctgacgcaggcggcgattgtcagccaagtggggcaatggggcgcgggcttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcattatggcgtggatcaaccttgtcgccatcctgctgctctcgcccttggcgtttatgctgctgcgcgattacaccgccaagctgaaaatgggcaaagaccccgagttcaaactttccgaacatccgggcctgaaacgccgtatcaaatccgacgtttggtaa

SEQ ID NO: 40249 - protein, 475 aa, Neisseria meningitidis
  misc_feature (27)..(27): Xaa can be any naturally occurring amino acid
MNENFTEWLHGWVGAINDPMWSYLVYXLLGTGLFFTVTTGFVQFRLFGRSIKEMLGGRKQGDDPHGITPFQAFVTGLASRVGVGNIAGVAIAIKVGGPGAVFWMWVTALIGMSSAFVESSLAQLFKVRDYDNHHFRGGPAYYITQGLGQKWLGVLFALSLIFCFGFVFEAVQTNTIADTVKAAWGWEPHYVGVALVILTAPIIFGGIRRISKAAEIVVPLMAVLYLFIALFIILTNIPMIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 40250 - DNA, 1080 bp, Neisseria gonorrhoeae
atggttcaaatacaggttgtgcgcgccgccggcgttgcccgtggtctgcattccgagtttgcgcgcgctgtaactgccgaggaaatagccttcgacaatgccgttttgaatcacgaagcgcggcgcggtggcaacaccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgtgccgacgaggtgtccgatcagcccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcattccgttttcgtcggcggcgacgacgctgcaggaaatgctgtggtgcgtgctttgccggtgtgcggcaaaaccgtgggtgttgccgtaaacgtattggtactgtccggtttgcaccgccgcgccttcggagttttcgatgcggctgtccgtgtccaacgctgcctgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcggcggcggcgcggacggtgtcgcgcagggcttgttcggagaagtcggcggtgccggcgcggcctttgcgtttgccgacgtaaacggtaatgtccagcgatttgtcctgctggaactcgatttgttcgatttcgcccaagcgcacgctgacgctttgtccgagcgattcgctgaagtcggcttcggcggcggtcgcgcccgctgcttttgccaagtcgagcgtgcggcggcagaggtcgaggagttcggaagcggtgtggttgaacagcataacaatctttcttggtggagcgttgtggcattttaa

SEQ ID NO: 40251 - protein, 359 aa, Neisseria gonorrhoeae
MVQIQVVRAAGVARGLHSEFARAVTAEEIAFDNAVLNHEARRGGNTFRIKIAAAERAGDVRFFAQVEEIGQDFFADAVDQETALAVERAAGECADEVSDQPARNGGIEEDGVAACRDAAAAESAQSAAGGGLTDGFGAVHIRMAAGGIVPVVALHSVFVGGDDAAGNAVVRALPVCGKTVGVAVNVLVLSGLHRRAFGVFDAAVRVQRCLFALFCQADGGFRIQIPFVVKVGVADVLRHQLGVGKSGATVFGGVAGDVGGGADGVAQGLFGEVGGAGAAFAFADVNGNVQRFVLLELDLFDFAQAHADALSERFAEVGFGGGRARCFCQVERAAAEVEEFGSGVVEQHNNLSWWSVVAF

SEQ ID NO: 40252 - DNA, 918 bp, Neisseria meningitidis
ggaaagagcgggggatgtgcgttcttcgcgcaggttgaggaaatcgggcaggacttttctgccgatgctgtcgatcaggaaactgctttggcggtagagcgcgccgccggagagtgcgccgacgaggtgtccgataagaccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgccttgccggtgtgcggcaaaaccgtgggtgttgccgtaaacgtattggtaatggccggtttgcaccgccgcgccttcggagttttcgatgcgctcatcctcgttcagggcggcttgttcgcattgttttgccaagccgacggcggctkccgtatccaaatcccattcgtggtaaaggtcggggtcgccgatgtgttttgccatcagacaggcatcggcaagtccggcgcaaccgtcttcggcggtgtggcgggcgatgtcgatggcggctttgacggtgtcttgcagggctttttcggagaagtcggcagtactggcgcggcctttgcgtttgccgacgtaaacggtaatgtccagcgacttgtcctgctggaactcgatttgttsgatttsgcccagccgcacgctgacgctttgtcccaatgattcgctgaaatcggcttcggcggcggttgcgcccgtcgcttttgccaagtcgagcgtgcggcggcagaggtcgaggagttcggaagcggtgtggttgaacagcatagaaatctttcttgatgatgctttgcggcattttaa

SEQ ID NO: 40253 - protein, 305 aa, Neisseria meningitidis
  misc_feature (167)..(167): Xaa can be any naturally occurring amino acid
  misc_feature (246)..(246): Xaa can be any naturally occurring amino acid
  misc_feature (248)..(248): Xaa can be any naturally occurring amino acid
  misc_feature (259)..(259): Xaa can be any naturally occurring amino acid
  misc_feature (299)..(300): Xaa can be any naturally occurring amino acid
GKSGGCAFFAQVEEIGQDFSADAVDQETALAVERAAGECADEVSDKTARNGGIEEDGVAACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGXRIQIPFVVKVGVADVFCHQTGIGKSGATVFGGVAGDVDGGFDGVLQGFFGEVGSTGAAFAFADVNGNVQRLVLLELDLXDXAQPHADALSQXFAEIGFGGGCARRFCQVERAAAEVEEFGSGVVEQHRNLSXXCFAAF

SEQ ID NO: 40254 - DNA, 1080 bp, Neisseria meningitidis
  misc_feature (775)..(778): n is a, c, g, or t
atggttcaaataaaggttgtgcgcgccgccggcgttgcccgtggtctgcattccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgctccgccggagagtgcgccgacgaggtgtccgataagaccgcccgaaacggtggtatcgaagaggacggggtagttgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgctttgccggtgtgcggcaaaaccgtaggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcnnnngcggcgcggacggtgtcgcgcagggcttgttcggagaaatcggcggtgccggcgcggcctttgcgtttgccgacgtaaacggtaatgtccagcgacttgtcctgctgaaactcgatttgttcgatttcgcccagccgcacgctgacgctttgtcccaatgattcgctgaaatcggcttcggcggcggttgcgcccgtcgcttttgccaagtcgagcgtgcggcggcagaggtcgaggagttcggaagcggtgtggttgaacagcatagaaatctttcttgatgatgctttgcggcattttaa

SEQ ID NO: 40255 - protein, 356 aa, Neisseria meningitidis
  misc_feature (259)..(260): Xaa can be any naturally occurring amino acid
MVQIKVVRAAGVARGLHSEFARAVTAEEIAFDNAVLNHEARCGGNAFRIKIAAAERAGDVRFFAQVEEIGQDFFADAVDQETALAVERSAGECADEVSDKTARNGGIEEDGVVACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVLRHQLGVGKSGATVFGGVAGDVXXGADGVAQGLFGEIGGAGAAFAFADVNGNVQRLVLLKLDLFDFAQPHADALSQFAEIGFGGGCARRFCQVERAAAEVEEFGSGVVEQHRNLSCFAAF

SEQ ID NO: 40256 - DNA, 1080 bp, Neisseria gonorrhoeae
atggttcaaatacaggttgtgcgcgccgccggcgttgcccgtggtctgcattccgagtttgcgcgcgctgtaactgccgaggaaatagccttcgacaatgccgttttgaatcacgaagcgcggcgcggtggcaacaccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgtgccgacgaggtgtccgatcagcccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcattccgttttcgtcggcggcaacgacgctgcaggaaatgctgtggtgcgtgctttgccggtgtgcggcaaaaccgtgggtgttgccgtaaacgtattggtagtgtccggtttgcaccgccgcgccttcggagttttcgatgcggctgtccgtgtccaacgctgcctgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcggcggcggcgcggacggtgtcgcgcagggcttgttcggagaagtcggcggtgccggcgcggcctttgcgtttgccgacgtaaacggtaatgtccagcgatttgtcctgctggaactcgatttgttcgatttcgcccaagcgcacgctgacgctttgtccgagcgattcgctgaagtcggcttcggcggcggtcgcgcccgctgcttttgccaagtcgagcgtgcggcggcagaggtcgaggagttcggaagcggtgtggttgaacagcataacaatctttcttggtggagcgttgtggcattttaa

SEQ ID NO: 40257 - protein, 359 aa, Neisseria gonorrhoeae
MVQIQVVRAAGVARGLHSEFARAVTAEEIAFDNAVLNHEARRGGNTFRIKIAAAERAGDVRFFAQVEEIGQDFFADAVDQETALAVERAAGECADEVSDQPARNGGIEEDGVAACRDAAAAESAQSAAGGGLTDGFGAVHIRMAAGGIVPVVALHSVFVGGNDAAGNAVVRALPVCGKTVGVAVNVLVVSGLHRRAFGVFDAAVRVQRCLFALFCQADGGFRIQIPFVVKVGVADVLRHQLGVGKSGATVFGGVAGDVGGGADGVAQGLFGEVGGAGAAFAFADVNGNVQRFVLLELDLFDFAQAHADALSERFAEVGFGGGRARCFCQVERAAAEVEEFGSGVVEQHNNLSWWSVVAF

SEQ ID NO: 40258 - DNA, 939 bp, Neisseria meningitidis
atggttcaaatacaggttgtgcgcgccgccggcgttgcccgtggtctgcataccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgcgccgacgaggtgtccgataagaccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgccttgccggtgtgcggcaaaaccgtgggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttttgccatcagacaggcatcggcaagtccggcgcaaccgtcttcggcggtgtggcgggcgatgtcgatggcggctttgacggtgtcttgcagggctttttcggagaagtcggcagtactggcgcggcctttgcgtttgccgacgtaaacggtaatgtccagcgacttgtcctgctggaactcgatttgttcgatttcgcccagccgcacgctgacgctttgtcccaatga

SEQ ID NO: 40259 - protein, 312 aa, Neisseria meningitidis
MVQIQVVRAAGVARGLHTEFARAVTAEEIAFDNAVLNHEARCGGNAFRIKIAAAERAGDVRFFAQVEEIGQDFFADAVDQETALAVERAAGECADEVSDKTARNGGIEEDGVAACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVFCHQTGIGKSGATVFGGVAGDVDGGFDGVLQGFFGEVGSTGAAFAFADVNGNVQRLVLLELDLFDFAQPHADALSQ

SEQ ID NO: 40260 - DNA, 939 bp, Neisseria meningitidis
atggttcaaataaaggttgtgcgcgccgccggcgttgcccgtggtctgcattccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgctccgccggagagtgcgccgacgaggtgtccgataagaccgcccgaaacggtggtatcgaagaggacggggtagttgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgctttgccggtgtgcggcaaaaccgtaggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcggcggcggcgcggacggtgtcgcgcagggcttgttcggagaaatcggcggtgccggcgcggcctttgcgtttgccgacgtaaacggtaatgtccagcgacttgtcctgctgaaactcgatttgttcgatttcgcccagccgcacgctgacgctttgtcccaatga

SEQ ID NO: 40261 - protein, 312 aa, Neisseria meningitidis
MVQIKVVRAAGVARGLHSEFARAVTAEEIAFDNAVLNHEARCGGNAFRIKIAAAERAGDVRFFAQVEEIGQDFFADAVDQETALAVERSAGECADEVSDKTARNGGIEEDGVVACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVLRHQLGVGKSGATVFGGVAGDVGGGADGVAQGLFGEIGGAGAAFAFADVNGNVQRLVLLKLDLFDFAQPHADALSQ

SEQ ID NO: 40262 - DNA, 714 bp, Neisseria gonorrhoeae
atgttgttccgtaaaacgaccgccgccgttttggcggcaaccttgatactgaacggctgtacgatgatgttgcgggggatgaacaacccggtcagccaaacaatcacccgcaaacacgttgacaaagaccaaatccgcgccttcggtgtggttgccgaagacaatgcccaattggaaaagggcagcctggtgatgatgggcgggaaatactggttcgccgtcaatcccgaagattcggcgaagctgacgggccttttgaaggccgggttggacaagcccttccaaatagttgaggataccccgagctatgcccgccaccaagccctgccggtcaaattcgaagcgcccggcagccagaatttcagtaccggaggtctttgcctgcgctatgataccggcagacctgacgacatcgccaagctgaaacagcttgagtttaaagcggtcaaactcgacaatcggaccatttacacgcgctgcgtatccgccaaaggcaaatactacgccacgccgcaaaaactgaacgccgattatcattttgagcaaagtgtgcccgccgatatttattatacggttactgaaaaacataccgacaaatccaagctgtttggaaatatcttatatacgccccccttgttgatattggatgcggcggccgcggtgctggtcttgcctatggctctgattgcagccgcgaattcctcagacaaatga

SEQ ID NO: 40263 - protein, 237 aa, Neisseria gonorrhoeae
MLFRKTTAAVLAATLILNGCTMMLRGMNNPVSQTITRKHVDKDQIRAFGVVAEDNAQLEKGSLVMMGGKYWFAVNPEDSAKLTGLLKAGLDKPFQIVEDTPSYARHQALPVKFEAPGSQNFSTGGLCLRYDTGRPDDIAKLKQLEFKAVKLDNRTIYTRCVSAKGKYYATPQKLNADYHFEQSVPADIYYTVTEKHTDKSKLFGNILYTPPLLILDAAAAVLVLPMALIAAANSSDK

SEQ ID NO: 40264 - DNA, 717 bp, Neisseria meningitidis
atgttgttccgtaaaacgaccgccgccgttttggcggcaaccttgatgctgaacggctgtacgttgatgttgtggggaatgaacaacccggtcagcgaaacaatcacccgcaaacacgttgacaaagaccaaatccgcgccttcggtgtggttgccgaagacaatgcccaattggaaaagggcagcctggtgatgatgggcggaaaatactggttcgtcgtcaatcccgaagattcggcgaagctgacgggcattttgaaggcagggctggacaaacccttccaaatagttgaggataccccgagctatgctcgccaccaagccctgccggtcaaactcgaatcgcctggcagccagaatttcagtaccgaaggcctttgcctgcgctacgataccgacaagcctgccgacatcgccaagctgaaacagctcgggtttgaagcggtcaaactcgacaatcggaccatttacacgcgctgcgtatccgccaaaggcaaatactacgccacaccgcaaaaactgaacgccgattaccattttgagcaaagtgtgcctgccgatatttattacacggttactgaagaacataccgacaaatccaagctgtttgcaaatatcttatatacgcccccctttttgatactggatgcggcgggcgcggtactggccttgcctgcggcggctctgggtgcggtcgtggatgccgcccgcaaatga

SEQ ID NO: 40265 - protein, 238 aa, Neisseria meningitidis
MLFRKTTAAVLAATLMLNGCTLMLWGMNNPVSETITRKHVDKDQIRAFGVVAEDNAQLEKGSLVMMGGKYWFVVNPEDSAKLTGILKAGLDKPFQIVEDTPSYARHQALPVKLESPGSQNFSTEGLCLRYDTDKPADIAKLKQLGFEAVKLDNRTIYTRCVSAKGKYYATPQKLNADYHFEQSVPADIYYTVTEEHTDKSKLFANILYTPPFLILDAAGAVLALPAAALGAVVDAARK

SEQ ID NO: 40266 - DNA, 714 bp, Neisseria meningitidis
atgttgttccgtaaaacgaccgccgccgttttggcggcaaccttgatgttgaacggctgtacggtaatgatgtggggtatgaacagcccgttcagcgaaacgaccgcccgcaaacacgttgacaaggaccaaatccgcgccttcggtgtggttgccgaagacaatgcccaattggaaaagggcagcctggtgatgatgggcgggaaatactggttcgtcgtcaatcctgaagattcggcgaagctgacgggcattttgaaggccgggttggacaagcagtttcaaatggttgagcccaacccgcgctttgcctaccaagccctgccggtcaaactcgaatcgcccgccagccagaatttcagtaccgaaggcctttgcctgcgctacgataccgacagacctgccgacatcgccaagctgaaacagcttgagtttgaagcggtcgaactcgacaatcggaccatttacacgcgctgcgtctccgccaaaggcaaatactacgccacaccgcaaaaactgaacgccgattatcattttgagcaaagtgtgcctgccgatatttattacacggttacgaaaaaacataccgacaaatccaagttgtttgaaaatattgcatatacgcccaccacgttgatactggatgcggtgggcgcggtgctggccttgcctgtcgcggcgttgattgcagccacgaattcctcagacaaatga

SEQ ID NO: 40267 - protein, 237 aa, Neisseria meningitidis
MLFRKTTAAVLAATLMLNGCTVMMWGMNSPFSETTARKHVDKDQIRAFGVVAEDNAQLEKGSLVMMGGKYWFVVNPEDSAKLTGILKAGLDKQFQMVEPNPRFAYQALPVKLESPASQNFSTEGLCLRYDTDRPADIAKLKQLEFEAVELDNRTIYTRCVSAKGKYYATPQKLNADYHFEQSVPADIYYTVTKKHTDKSKLFENIAYTPTTLILDAVGAVLALPVAALIAATNSSDK

SEQ ID NO: 40268 - DNA, 504 bp, Neisseria gonorrhoeae
atgcatcgggtttcagacggcattggagtgtcagtcgtgttctgccgattcgtaggcttcgacgattttttgcaccagaggatgccggacaacgtcttcgccggtgaaggtatggaaatacagtcctgccacgccgtgcagtttctcacgtgcgtctttcaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcgatttcaatcaggcctttttcaatcagcttggttacacggtcaaagcccatcaggtcatagagggcatcataaagcggacggaggtaggggtcgactttttgggtcaggtctccgggcaggaagcccagtttctcaccggcttcgacggcaggccgaactaa

SEQ ID NO: 40269 - protein, 167 aa, Neisseria gonorrhoeae
MHRVSDGIGVSVVFCRFVGFDDFLHQRMPDNVFAGEGMEIQSCHAVQFLTCVFQSRFDVFGQVDLAGVAGNDGFRAEADAGQEHFHLFGRGVLRFVEDDVCAVERPAAHIGERGDFNQAFFNQLGYTVKAHQVIEGIIKRTEVGVDFLGQVSGQEAQFLTGFDGRPN

SEQ ID NO: 40270 - DNA, 504 bp, Neisseria meningitidis
atgcatcgggtttcagacggcattggaatgtcagtcgtgttctgccgattcgtaggcttcgacgattttttgcaccaaaggatgccggacaacgtcttcgccggtaaaggtgtggaaatacagcccttccacgttgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcgatttcaatcaggcctttttcaatcagcttggttacacggtcaaagcccatcaggtcatagagggcatcataaagcggacgaaggtagggatcgactttctgggtcaggtctccgggcaggaagcccagtttctcgccggcttcgacggctgggcgcactaa

SEQ ID NO: 40271 - protein, 167 aa, Neisseria meningitidis
  misc_feature (54)..(54): Xaa can be any naturally occurring amino acid
MHRVSDGIGMSVVFCRFVGFDDFLHQRMPDNVFAGKGVEIQPFHVVQFLTRIFXSRFDVFGQVDLAGVAGNDGFRAEADAGQEHFHLFGRGVLRFVEDDVCAVERPAAHIGERGDFNQAFFNQLGYTVKAHQVIEGIIKRTKVGIDFLGQVSGQEAQFLAGFDGWAH

SEQ ID NO: 40272 - DNA, 504 bp, Neisseria meningitidis
atgcatcgggtttcagacggcattggaatgtcagtcgtgttctgccgattcgtaggcttcgacgattttttgcaccaaaggatgccggacaacgtcttcgccggtaaaggtgtggaaatacagcccttccacgccgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcaatctcaatcagacctttttcaatcagcttggtgacacggtcgaagcccatcaggtcatagagggcatcataaagcggacgaaggtagggatcgactttctgggtcaggtcaccgggcagaaaacccagtttctcgccggcttcgacggcaggccgcactaa

SEQ ID NO: 40273 - protein, 166 aa, Neisseria meningitidis
MHRVSDGIGMSVVFCRFVGFDDFLHQRMPDNVFAGKGVEIQPFHAVQFLTRIFSRFDVFGQVDLAGVAGNDGFRAEADAGQEHFHLFGRGVLRFVEDDVCAVERPAAHIGERGNLNQTFFNQLGDTVEAHQVIEGIIKRTKVGIDFLGQVTGQKTQFLAGFDGRPH

SEQ ID NO: 40274 - DNA, 348 bp, Neisseria gonorrhoeae
atgacgttttcggcggcaaagctcaacatttcggcactgatgttgtgtctttcggcaggaatgaccgttttactttccgcttttttactgctccgaccggaaggcagcatcttattcaaccattttttcagcataaatattctgacccgaagagcggcatctccacgggcaaccgtgttcagactgcatcaggcggtacgattccacaagatgccgaaaaccataagcaaaatgcgtagaaactacgccgtccgaatcacgccgcctcctcgggcggcaacgcttcattataacagattgccccttaaaaaatcagaccctgcttttgtggcggagtctgaaatttga

SEQ ID NO: 40275 - protein, 115 aa, Neisseria gonorrhoeae
MTFSAAKLNISALMLCLSAGMTVLLSAFLLLRPEGSILFNHFFSINILTRRAASPRATVFRLHQAVRFHKMPKTISKMRRNYAVRITPPPRAATLHYNRLPLKKSDPAFVAESEI

SEQ ID NO: 40276 - DNA, 401 bp, Neisseria meningitidis
atgacgttttcggcggcaaagctcaacatttcggcacggatgttgtgtctttcggcaggaatgaccgttttactttccgcttttttactgctccgaccggaaggcagcatcttattcaaccattttttcagcataaatattctgacccgaagagcggcatctccacaggcaaccgtgttcagacggcatcaggcgcggtttgcaagatgccgtaccataaacaaaaggcgtagaaactacgccgtccgaatcacgccgccctcgcggcggcaacgcgtcattataacagattgccctccgcggcaggcttagtgcggcgggagcgccgccgttgcgcagtaatattgtctaacgggaggaaaaaatcagaccctgcttttgtggcagagtctgaaatttga

SEQ ID NO: 40277 - protein, 133 aa, Neisseria meningitidis
  misc_feature (89)..(89): Xaa can be any naturally occurring amino acid
MTFSAAKLNISARMLCLSAGMTVLLSAFLLLRPEGSILFNHFFSINILTRRAASPQATVFRRHQARFARCRTINKRRRNYAVRITPPSXAATRHYNRLPSAAGLVRRERRRCAVILSNGRKKSDPAFVAESEI

SEQ ID NO: 40278 - DNA, 344 bp, Neisseria meningitidis
atgacgttttcggcggcaaagctcaacatttcggcacggatgttgtgtctttcggcaggaatgaccgttttactttccgcttttttactgctccgaccggaaggcagcatcttattcaaccattttttcagcataaatattctaacccgaagagcggcatctccacgggcaaccgtgttcagacggcatcaggcggtacgattccgcaagatgccgaccataaacaaaaggcgtagaaactacgccgtccgaatcacgccgtcctcgcggcggcaacgcgtcattataacagattgccctccaaaaaatcagaccctgcttttgtggcagagtctgaaatttga

SEQ ID NO: 40279 - protein, 114 aa, Neisseria meningitidis
  misc_feature (90)..(90): Xaa can be any naturally occurring amino acid
MTFSAAKLNISARMLCLSAGMTVLLSAFLLLRPEGSILFNHFFSINILTRRAASPRATVFRRHQAVRFRKMPTINKRRRNYAVRITPSSXAATRHYNRLPSKKSDPAFVAESEI

SEQ ID NO: 40280 - DNA, 951 bp, Neisseria gonorrhoeae; identical to SEQ ID NO: 38735

SEQ ID NO: 40281 - protein, 316 aa, Neisseria gonorrhoeae; identical to SEQ ID NO: 38736

SEQ ID NO: 40282 - DNA, 600 bp, Neisseria meningitidis; identical to SEQ ID NO: 38733

SEQ ID NO: 40283 - protein, 199 aa, Neisseria meningitidis; identical to SEQ ID NO: 38734

SEQ ID NO: 40284 - DNA, 948 bp, Neisseria meningitidis; identical to SEQ ID NO: 38737

SEQ ID NO: 40285 - protein, 315 aa, Neisseria meningitidis; identical to SEQ ID NO: 38738

SEQ ID NO: 40286 - DNA, 948 bp, Neisseria gonorrhoeae; identical to SEQ ID NO: 38741

SEQ ID NO: 40287 - protein, 315 aa, Neisseria gonorrhoeae; identical to SEQ ID NO: 38742

SEQ ID NO: 40288 - DNA, 948 bp, Neisseria meningitidis; identical to SEQ ID NO: 38739

SEQ ID NO: 40289 - protein, 315 aa, Neisseria meningitidis; identical to SEQ ID NO: 38740

SEQ ID NO: 40290 - DNA, 948 bp, Neisseria meningitidis; identical to SEQ ID NO: 38737

SEQ ID NO: 40291 - protein, 315 aa, Neisseria meningitidis; identical to SEQ ID NO: 38738

SEQ ID NO: 40292 - DNA, 594 bp, Neisseria gonorrhoeae
atgcctgcgcttctttcaatacgtcgggcaaacgcgctgcctttttcgcgcatttcggaaaggatgaagttgctggtgccgttaataatgccggcgatggatttaatcctgtttgccgccaaaccttcgcgcacggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcttctttggcaatgcccgtgccgccgaacaattcgaccaagacatcgacgtctttacgcgcgaacagttcgaacggatcttttgacaagggcgggcgacgggccgattttggcgggctttttcttcgcttaagtcgcacatggcagaaatacggatttcgcgccccaagcggcgggaaatttcctctgcgttgtcccgcaacacggcagccgcaccgccgccgaccgtacctaagcctaaaagaccgatgtttactggcttcattgtgtctccttgtaagccgactgaaatgtaaatattga

SEQ ID NO: 40293 - protein, 197 aa, Neisseria gonorrhoeae
MPALLSIRRANALPFSRISERMKLLVPLIMPAMDLILFAAKPSRTALMIGIPPATAASNWTMTFCFSASGKISLPYSASSFLLAVTMCLPFSMAFNTASLAMPVPPNNSTKTSTSLRANSSNGSFDKGGRRADFGGLFLRLSRTWQKYGFRAPSGGKFPLRCPATRQPHRRRPYLSLKDRCLLASLCLLVSRLKCKY

SEQ ID NO: 40294 - DNA, 592 bp, Neisseria meningitidis
atgcctgcgcttctttcagtacatcggcaaacgcgctgcctttttcgcgcatttcggrkaggatgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgccggacgggcaggtttgtcgggctttttcttcactcaaatcgcacacggcagaaatacggatttcgcgccccaagcgacgggaaatttcctccgcgttgtcscgcaacacggcagccgtaccgccgccgaccgtacccaaacctaaaagaccgatgtttactggcttcattgtgtctccttgtaagccgactgaaatgtaaatattga

SEQ ID NO: 40295 - protein, 197 aa, Neisseria meningitidis
  misc_feature (9)..(9): Xaa can be any naturally occurring amino acid
  misc_feature (20)..(20): Xaa can be any naturally occurring amino acid
  misc_feature (129)..(129): Xaa can be any naturally occurring amino acid
  misc_feature (163)..(163): Xaa can be any naturally occurring amino acid
MPALLSVHXANALPFSRISXRMKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAXRTGRFVGLFLHSNRTRQKYGFRAPSDGKFPPRCXATRQPYRRRPYPNLKDRCLLASLCLLVSRLKCKY

SEQ ID NO: 40296 - DNA, 591 bp, Neisseria meningitidis
atgcctgcgcttctttcagtacatcggcaaacgcgctgcctttttcgcgcatttcggagaggatgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgcggacgggcaggtttgtcgggctttttcttcactcaaatcgcacacggcagaaatacggatttcgcgccccaagcgacgggaaatttcctccgcgttgtcccgcaacacggcagccgtaccgccgccgaccgtacccaaacctaaaagaccgatgtttactggcttcattgtgtctccttgtaagccgactgaaatgtaaatattga

SEQ ID NO: 40297 - protein, 197 aa, Neisseria meningitidis
  misc_feature (10)..(10): Xaa can be any naturally occurring amino acid
  misc_feature (129)..(129): Xaa can be any naturally occurring amino acid
MPALLSVHRXNALPFSRISERMKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAXRTGRFVGLFLHSNRTRQKYGFRAPSDGKFPPRCPATRQPYRRRPYPNLKDRCLLASLCLLVSRLKCKY

SEQ ID NO: 40298 - DNA, 522 bp, Neisseria gonorrhoeae
atgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcttctttggcaatgcccgtgccgccgaacaattcgacgacgacatcgacgtctttacgcgcgaccagttcgaacggatctttgacaaaggcggcggacgggcagatttggcgggctttttcttcgcttaagtcgcacatggcagaaatacggatttcgcgccccaagcggcgggaaatttcctctgcgttgtcccgcaacacggcagccgcaccgccgccgaccgtacctaagcctaaaagaccgatgtttactggcttcattgtgtctccttgtaagccgactgaaatgtaa

SEQ ID NO: 40299 - protein, 173 aa, Neisseria gonorrhoeae
MKLLVPLIMPAMDLILFAAKPSRRALMIGIPPATAASNWTMTFCFSASGKISLPYSASSFLLAVTMCLPFSMAFNTASLAMPVPPNNSTTTSTSLRATSSNGSLTKAADGQIWRAFSSLKSHMAEIRISRPKRREISSALSRNTAAAPPPTVPKPKRPMFTGFIVSPCKPTEM

SEQ ID NO: 40300 - DNA, 522 bp, Neisseria meningitidis
atgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgcggacgggcaggtttgtcgggctttttcttcactcaaatcgcacacggcagaaatacggatttcgcgccccaagcgacgggaaatttcctccgcgttgtcccgcaacacggcagccgtaccgccgccgaccgtacccaaacctaaaagaccgatgtttactggcttcattgtgtctccttgtaagccgactgaaatgtaa

SEQ ID NO: 40301 - protein, 173 aa, Neisseria meningitidis
MKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAADGQVCRAFSSLKSHTAEIRISRPKRREISSALSRNTAAVPPPTVPKPKRPMFTGFIVSPCKPTEM

SEQ ID NO: 40302 - DNA, 522 bp, Neisseria meningitidis; identical to SEQ ID NO: 40300

SEQ ID NO: 40303 - protein, 173 aa, Neisseria gonorrhoeae; identical to SEQ ID NO: 40301

SEQ ID NO: 40304 - DNA, 513 bp, Neisseria gonorrhoeae
atgaaatcaaaactccccttaatcctaatcaacctttccctgatttcaagcccattgggtgcgaatgcggccaaaatctatacctgcacaatcaacggagaaaccgtttacaccaccaagccgtctaaaagctgccactcaaccgatttgcccccaatcggcaactacagcagcgaacgctatatcctgccccaaactcccgaaccggcaccatcaccgtcaaacggcggacaggctgtcaaatataaagccccggtcaaaacagtatccaagccggcaaaatccaatacgccgcctcaacaagcacctgtaaataacagcagacgctccattctcgaagcagaattaagcaatgaacgcaaagccctgactgaagcccaaaaaatgttatcacaagcacgtctggcaaaaggcggcaacatcaaccatcaaaaaatcaacgcattgtaaagcaatgttttggacagacagcaaaatatccaagcactgcaaagagaattgggacgtatgtaa

SEQ ID NO: 40305 - protein, 169 aa, Neisseria meningitidis
MKSKLPLILINLSLISSPLGANAAKIYTCTINGETVYTTKPSKSCHSTDLPPIGNYSSERYILPQTPEPAPSPSNGGQAVKYKAPVKTVSKPAKSNTPPQQAPVNNSRRSILEAELSNERKALTEAQKMLSQARLAKGGNINHQKINALSNVLDRQQNIQALQRELGRM

SEQ ID NO: 40306 - DNA, 516 bp, Neisseria meningitidis
atgaaatcaaaactcctcttaatcctaatcaacttttccctgatttcaagcccattgggtgcgaatgcggccaaaatctasacctgcacaatcaacggagaaaccgtttacaccascaagccgtccaaaagctgccactcaaccgatttgcccccaatcggcaactacagcagcgaacgctatatcccgccccaaacgcccgaaccggtatcatcaccgtcaaacggcggacwggttgtcaaatataaagccccggtcaaaacagtatccaagccggcaaaatccartacgccgccgccgcaacaagcaccctcaaacaacagcagacgctccattctcgaaacagaattgagcaacgaacgcaaagcattggttgaagcccaaaaaatgttatcacaagcacgtctggcaaagggcggcaacatcaaccatcaagaaataaatgcattacaaagcaatgtattggacaggcagcaaaatattcaagccctgcaaagggaactggggcgtatgtaa

SEQ ID NO: 40307 - protein, 171 aa, Neisseria meningitidis
  misc_feature (27)..(27): Xaa can be any naturally occurring amino acid
  misc_feature (39)..(39): Xaa can be any naturally occurring amino acid
  misc_feature (78)..(78): Xaa can be any naturally occurring amino acid
  misc_feature (96)..(96): Xaa can be any naturally occurring amino acid
MKSKLLLILINFSLISSPLGANAAKIXTCTINGETVYTXKPSKSCHSTDLPPIGNYSSERYIPPQTPEPVSSPSNGGXVVKYKAPVKTVSKPAKSXTPPPQQAPSNNSRRSILETELSNERKALVEAQKMLSQARLAKGGNINHQEINALQSNVLDRQQNIQALQRELGRM

SEQ ID NO: 40308 - DNA, 516 bp, Neisseria meningitidis
atgaaatcaaaactccccttaatcctaatcaacttttccctgatttcaagcccattgggtgcgaatgcggccaaaatctacacctgcacaatcaacggagaaaccgtttacaccaccaagccgtccaaaagctgcctctcaaccgatttgcccccaatcggcaactacagcagcgaacgctatatcccgccccaaacatccgaaccgacaccatcaccgtcaaacggcggacaggctgtcaaatataaagccccggtcaaaacagtatccaagccggcaaaatccaatacgccgccgccgcaacaagcaccctcaaacaacagcagacgctccattctcgaaacagaattgagcaacgaacgcaaagcattggttgaagcccaaaaaatgttatcacaagcacgtctggcaaaaggcggcaacatcaaccatcaagaaatcaacgcattgcaaagcaatgtattggacaggcagcaaaatatccaagcactgcaaagagaattgggacgtatgtaa

SEQ ID NO: 40309 - protein, 170 aa, Neisseria gonorrhoeae
MKSKLPLILINFSLISSPLGANAAKIYTCTINGETVYTTKPSKSCLSTDLPPIGNYSSERYIPPQTSEPTPSPSNGGQAVKYKAPVKTVSKPAKSNTPPPQQAPSNNSRRSILETELSNERKALVEAQKMLSQARLAKGGNINHQEINALQSVLDRQQNIQALQRELGRM

SEQ ID NO: 40310 - DNA, 435 bp, Neisseria gonorrhoeae
atgactgagccgaaacacgaaacgccgacggaagagcaggttgccgcgcgcaaaaaagcaaaagccaaaatccgcaccatccgcatttgggcgtgggtcattttggcgttgctcgcttcaaccgccctgctctcccaatgcgcgatgtccaaaccgcaggcaaaacagaaaattgtcgagtcttgcatgaaaaatattccgtttgctgaaaaatggcagaacgatttgaaagcgcgcggcttggatgcggacaatacccgtctcgccgtcgactactgcaaatgtatgtgggagcagcctttggacggattgagcgagaaacagatcagctccttcggcaaactcggtgcacaagaacagcttgacctgctcggcggcgcaaacgcgtttgaaactcgagacaaacaatgtgtcgcggatttgaaagccgattga

SEQ ID NO: 40311 - protein, 144 aa, Neisseria meningitidis
MTEPKHETPTEEQVAARKKAKAKIRTIRIWAWVILALLASTALLSQCAMSKPQAKQKIVESCMKNIPFAEKWQNDLKARGLDADNTRLAVDYCKCMWEQPLDGLSEKQISSFGKLGAQEQLDLLGGANAFETRDKQCVADLKAD

SEQ ID NO: 40312 - DNA, 435 bp, Neisseria meningitidis
atgactgagccgaaacacgaaatgctgacgaaagagcaggttgccgcgcgcaaaaaagcaaaagccaaaatccgcaccatccgcatttgggcgtgggtcattttggcgttgctcgctttaaccgccctgctctcccaatgcgcgatgtccaaaccgcaggcaaaacagaaaattgtcgagtcttgcgtgaagaatattccgtttgccgaaaaatggcaaaacgatttgcgggcccgcggtttagattcaaacaatacccgcctcgccgtcgactactgcaaatgtatgtgggagcagcctttggacagattgagcgagaaacagattagatccttcggcaaactcggcgcacaagaacagcttgacctgctcggcggcgcaaatgcctttgaagcacgtgacaagcagtgtgttgccgatttgaaatcagaataa

SEQ ID NO: 40313 - protein, 144 aa, Neisseria meningitidis
MTEPKHEMLTKEQVAARKKAKAKIRTIRIWAWVILALLALTALLSQCAMSKPQAKQKIVESCVKNIPFAEKWQNDLRARGLDSNNTRLAVDYCKCMWEQPLDRLSEKQIRSFGKLGAQEQLDLLGGANAFEARDKQCVADLKSE

SEQ ID NO: 40314 - DNA, 435 bp, Neisseria meningitidis
atgactgagccgaaacacgaaatgccgacggaagagcaggttgccgcgcgcaaaaaagcaaaagccaaaatccgcaccatccgcatttgggcatgggtcattttggcgttgctcgcttcaaccgccctgctctcccaatgcgcgatgtccaaaccgcaggcaaaacagaaaattgtcgagtcttgcgtgaagaatattccgtttgccgaaaaatggcaaaacgatttgcgggcccgcggtttagattcaaacaatacccgccttaccgtcgactactgcaaatgtatgtgggagcagcctttggacagattgagcgagaaacagattagttccttcggcaaactcggcgcacaagaacagcttgacctgctcggcggcgcaaatgcctttgaaacgcgagacaagcagtgtgttgccgatttgaaatcagaataa

SEQ ID NO: 40315 - protein, 144 aa, Neisseria gonorrhoeae
MTEPKHEMPTEEQVAARKKAKAKIRTIRIWAWVILALLASTALLSQCAMSKPQAKQKIVESCVKNIPFAEKWQNDLRARGLDSNNTRLTVDYCKCMWEQPLDRLSEKQISSFGKLGAQEQLDLLGGANAFETRDKQCVADLKSE

SEQ ID NO: 40316 - DNA, 408 bp, Neisseria gonorrhoeae
atgactgtatggtttgttgccgctgttgccgtcttaatcatcgaattattgacgggaacggtttatcttttggttgtcagcgcggctttggcgggttcgggcattgcctacgggctgactggcagcacgcctgccgccgtcttgaccgccgcactgctttccgcgctgggcatttggttcgtacatgccaaaaccgccgtgggaaaagttgaaacggattcatatcaggatttggataccggaaaatatgccgaaatcctccgatacacaggcggcaaccgttacgaagttttttatcgcggtacgcactggcaggcgcaaaatacggggcaggaagtgtttgaaccgggaacgcgcgccctcatcgtccgcaaagaaggtaaccttcttatcatcgcaaacccttaa

SEQ ID NO: 40317 - protein, 135 aa, Neisseria meningitidis
MTVWFVAAVAVLIIELLTGTVYLLVVSAALAGSGIAYGLTGSTPAAVLTAALLSALGIWFVHAKTAVGKVETDSYQDLDTGKYAEILRYTGGNRYEVFYRGTHWQAQNTGQEVFEPGTRALIVRKEGNLLIIANP

SEQ ID NO: 40318 - DNA, 381 bp, Neisseria meningitidis
  misc_feature (51)..(51): n is a, c, g, or t
  misc_feature (122)..(122): n is a, c, g, or t
  misc_feature (149)..(149): n is a, c, g, or t
gccgtcttaatcatcgaattattgacgggaacggtttatcttttggttgtnagcgcggctttggcgggttcgggcattgcttacgggctgaccggcagtacgcctgccgccgtcttgaccgncgctctgctttccgcgctgggtatttngttcgtacacgccaaaaccgccgttagaaaagttgaaacggattcatatcaggatttggatgccggacaatatgtcgaaatcctccgacacacaggcggcaaccgttacgaagttttttatcgcggtacgcactggcaggctcaaaatacggggcaagaagagcttgaaccaggaactcgcgccctcattgtccgcaaggaaggcaaccttcttattatcacacacccttaa

SEQ ID NO: 40319 - protein, 126 aa, Neisseria meningitidis
  misc_feature (41)..(41): Xaa can be any naturally occurring amino acid
  misc_feature (50)..(50): Xaa can be any naturally occurring amino acid
AVLIIELLTGTVYLLVVSAALAGSGIAYGLTGSTPAAVLTXALLSALGIXFVHAKTAVRKVETDSYQDLDAGQYVEILRHTGGNRYEVFYRGTHWQAQNTGQEELEPGTRALIVRKEGNLLIITHP

SEQ ID NO: 40320 - DNA, 408 bp, Neisseria meningitidis
atgactgtatggtttgttgccgctgttgccgtcttaatcatcgaattattgacgggaacggtttatcttttggttgtcagcgcggctttggcgggttcgggcattgcttacgggctgaccggcagcacgcctgccgccgtcttgaccgccgctctgctttccgcgctgggtatttggttcgtacacgccaaaaccgccgtgggaaaagttgaaacggattcatatcaggatttggatgccgggcaatatgccgaaatcctccggcacgcaggcggcaaccgttacgaagttttttatcgcggtacgcactggcaggctcaaaatacggggcaagaagagcttgaaccaggaacgcgcgccctaatcgtccgcaaggaaggcaaccttcttatcatcgcaaaaccttaa

SEQ ID NO: 40321 - protein, 135 aa, Neisseria gonorrhoeae
MTVWFVAAVAVLIIELLTGTVYLLVVSAALAGSGIAYGLTGSTPAAVLTAALLSALGIWFVHAKTAVGKVETDSYQDLDAGQYAEILRHAGGNRYEVFYRGTHWQAQNTGQEELEPGTRALIVRKEGNLLIIAKP

SEQ ID NO: 40322 - DNA, 561 bp, Neisseria gonorrhoeae
atgaagtacgtccggttatttttcctcggcacggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattgaaacagccggttaccaatatttcctggtttgccgccaacgcctattgcgccgcacaaggcaaacgcctgccgaccatcgacgaatgggaatttgccggacttgcttccgccacgcagaaaaaacggctcaaacgaacccggctacaaccgcactattctcgattggtatgccgacggcggacggaaaggcctgcacgatgtcggcaaagcaccgcccgaactactggggtgtttatgatatgcacgggctga

SEQ ID NO: 40323 - protein, 186 aa, Neisseria meningitidis
MKYVRLFFLGTALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNISWFAANAYCAAQGKRLPTIDEWEFAGLASATQKKRLKRTRLQPHYSRLVCRRRTERPARCRQSTARTTGVFMICTG

SEQ ID NO: 40324 - DNA, 559 bp, Neisseria meningitidis
atgaagtatgtccggttattttwcctcggcgcggcactcgccrrcactcaarcggcggctgccgaaatggttcaaatcgaaggcggcagctaccgcccrctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattaaaacaaccggtaaccaatgtttcctggwttgccgccaacgcctattgcgccgcacaaggcaaacgcctgccgaccattgacgaatgggaatttgccggacttgcttccgccacgcagaaaaacggctcaaacgaacccggctacaaccgcactattctcgattggtatgccgacggcggacggaaaggcctgcacgatgtcggcaaaggccgcccgaactactggggcgtttatgatatgcacgggctga

SEQ ID NO: 40325 - protein, 186 aa, Neisseria meningitidis
  misc_feature (8)..(8): Xaa can be any naturally occurring amino acid
  misc_feature (15)..(15): Xaa can be any naturally occurring amino acid
  misc_feature (18)..(18): Xaa can be any naturally occurring amino acid
  misc_feature (113)..(113): Xaa can be any naturally occurring amino acid
  misc_feature (144)..(144): Xaa can be any naturally occurring amino acid
  misc_feature (172)..(172): Xaa can be any naturally occurring amino acid
MKYVRLFXLGAALAXTQXAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNVSWXAANAYCAAQGKRLPTIDEWEFAGLASATQKXRLKRTRLQPHYSRLVCRRRTERPARCRXKAARTTGAFMICTG

SEQ ID NO: 40326 - DNA, 559 bp, Neisseria meningitidis
atgaagtttacccggttactctttctctgtgcggcactcgccggcactcaagcggcagctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgatttaaaacaaccggtaaccaatgtttcctggttcgccgccaacgcctattgcgccgcacaaggcaaacgcctgccgaccattgacgaatgggaatttgccggacttgcctccgccacgcagaaaaacggctcaaacgaacccggctacaaccgcactattctcgactggtatgcggatggcgaccggaaagacctgcacgatgtcggcaaaggtcgcccgaactactggggcgtttatgatatgcacggtctga

SEQ ID NO: 40327 - protein, 186 aa, Neisseria gonorrhoeae
  misc_feature (143)..(143): Xaa can be any naturally occurring amino acid
  misc_feature (173)..(173): Xaa can be any naturally occurring amino acid
MKFTRLLFLCAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGDLKQPVTNVSWFAANAYCAAQGKRLPTIDEWEFAGLASATQXKRLKRTRLQPHYSRLVCGWRPERPARCRQXVARTTGAFMICTV

SEQ ID NO: 40328 - DNA, 756 bp, Neisseria gonorrhoeae
atgaagtacgtccggttatttttcctcggcacggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattgaaacagccggttaccaatatttcctggtttgccgccaacgcctattgcgccgcacaaggcaaacgcctgccgaccatcgacgaatgggaatttgccggacttgcttccgccacgcagaaaaacggctcaaacgaacccggctacaaccgcactattctcgattggtatgccgacggcggacggaaaggcctgcacgatgtcggcaaagaccgcccgaactactggggtgtttatgatatgcacgggctgatttgggaatggacggaagatttcaacagcagcctgctttcttccggcaatgccaacgcgcaaatgttttgcagcggcgcatctgtcggggcgagcgactcgtccaactatgccgccttcctccgctacggcatccgcaccagcctgcaatccaaatacgtcctgcacaacttgggcttccgctgcgcaagccgataa

SEQ ID NO: 40329 - protein, 251 aa, Neisseria meningitidis
MKYVRLFFLGTALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNISWFAANAYCAAQGKRLPTIDEWEFAGLASATQKNGSNEPGYNRTILDWYADGGRKGLHDVGKDRPNYWGVYDMHGLIWEWTEDFNSSLLSSGNANAQMFCSGASVGASDSSNYAAFLRYGIRTSLQSKYVLHNLGFRCASR

SEQ ID NO: 40330 - DNA, 756 bp, Neisseria meningitidis
atgaagtatgtccggttatttttcctcggcgcggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattaaaacaaccggtaaccaatgtttcctggtttgccgccaacgcctattgcgccgcacaaggcaaacgcctgccgaccattgacgaatgggaatttgccggacttgcttccgccacgcagaaaaacggctcaaacgaacccggctacaaccgcactattctcgattggtatgccgacggcggacggaaaggcctgcacgatgtcggcaaaggccgcccgaactactggggcgtttatgatatgcacgggctgatttgggaatggacggaagatttcaacagcagcctgctttcttccggcaatgccaacgcgcaaatgttttgcagcggcgcgtctatcgggtcgagcgactcgtccaactatgccgccttcctccgctacggcatccgtaccagcctgcaatccaaatatgtcttgcacaacttgggcttccgttgcacaagccgataa

SEQ ID NO: 40331 - protein, 251 aa, Neisseria meningitidis
MKYVRLFFLGAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNVSWFAANAYCAAQGKRLPTIDEWEFAGLASATQKNGSNEPGYNRTILDWYADGGRKGLHDVGKGRPNYWGVYDMHGLIWEWTEDFNSSLLSSGNANAQMFCSGASIGSSDSSNYAAFLRYGIRTSLQSKYVLHNLGFRCTSR

SEQ ID NO: 40332 - DNA, 756 bp, Neisseria meningitidis
atgaagtttacccggttactctttctctgtgcggcactcgccggcactcaagcggcagctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgatttaaaacaaccggtaaccaatgtttcctggttcgccgccaacgcctattgcgccgcacaaggcaaacgcctgccgaccattgacgaatgggaatttgccggacttgcctccgccacgcagaaaaacggctcaaacgaacccggctacaaccgcactattctcgactggtatgcggatggcgaccggaaagacctgcacgatgtcggcaaaggtcgcccgaactactggggcgtttatgatatgcacggtctgatttgggaatggacggaagatttcaacagcagcctgctttcttccggcaatgccaacgcgcaaatgttttgcagcggcgcgtctatcgggtcgagcgactcgtccaactatgccgccttcctccgctacggcatccgcaccagcctgcaatccaaatatgtcttgcacaacttgggcttccgttgcacaagccgataa

SEQ ID NO: 40333 - protein, 251 aa, Neisseria gonorrhoeae
MKFTRLLFLCAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGDLKQPVTNVSWFAANAYCAAQGKRLPTIDEWEFAGLASATQKNGSNEPGYNRTILDWYADGDRKDLHDVGKGRPNYWGVYDMHGLIWEWTEDFNSSLLSSGNANAQMFCSGASIGSSDSSNYAAFLRYGIRTSLQSKYVLHNLGFRCTSR

SEQ ID NO: 40334 - DNA, 453 bp, Neisseria gonorrhoeae
atggttttaccagtctccttttttcagcctgtccagttggcggcggtcgcgcttggtcggtctgccgtcgggatgggcggaagtgatgcggctgaattggtcgagctgtttgcactcttccctcaatgctgccgttttcgcgtcttcttcatacagaagccgcgcctcgggtgccgggcggcgttggtggttcaaacctttaaccttgattttatggggaagggaattgagcgtcaggtcgataatatcgccgatgtctatggttttactgtttttgactttcgagccgtttacttgaaccctacccagttcgatatgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataa

SEQ ID NO: 40335 - protein, 150 aa, Neisseria gonorrhoeae
MVLPVSFFQPVQLAAVALGRSAVGMGGSDAAELVELFALFPQCCRFRVFFIQKPRLGCRAALVVQTFNLDFMGKGIERQVDNIADVYGFTVFDFRAVYLNPTQFDMLLRKGTGLEKTCRPKPFVQPHGGRIVLVFHTILFEIIEFVSSLA

SEQ ID NO: 40336 - DNA, 452 bp, Neisseria meningitidis
atggttttaccagtctccttttttcagcctgtccagttggcggcggtcgcgcttggtcggtctgccgtcgggataggcggaagtgatgcggctgaattggtcgagctgtttgcgctcttccctcaatgttgccgttwtcgcgtcctcttcatacagaagccgcgcytcggatgccgggcggcgttggtggttcaaacctttaaccktgattttatagggaagggaattkagcktcagtygrtwatatcgcsgatgtmtatggttttactgtttttgaccttcgagccgtttacttgaaccctacccagttcgatgtgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataa

SEQ ID NO: 40337 - protein, 150 aa, Neisseria meningitidis
  misc_feature (46)..(46): Xaa can be any naturally occurring amino acid
  misc_feature (56)..(56): Xaa can be any naturally occurring amino acid
  misc_feature (69)..(69): Xaa can be any naturally occurring amino acid
  misc_feature (75)..(75): Xaa can be any naturally occurring amino acid
  misc_feature (77)..(77): Xaa can be any naturally occurring amino acid
  misc_feature (81)..(82): Xaa can be any naturally occurring amino acid
MVLPVSFFQPVQLAAVALGRSAVGIGGSDAAELVELFALFPQCCRXRVLFIQKPRXGCRAALVVQTFNXDFIGKXNXASVXXIADVYGFTVFDLRAVYLNPTQFDVLLRKGTGLEKTCRPKPFVQPHGGRIVLVFHTILFEIIEFVSSLA

SEQ ID NO: 40338 - DNA, 453 bp, Neisseria meningitidis
atggttttaccagtctccttttttcagcctgtccagttggcggcggtcgcgcttggtcggtctgccgtcgggataggcggaagtgatgcggctgaattggtcgagctgtttgcgctcttccctcaatgttgccgttttcgcgtcctcttcatacagaagccgcgcctcggatgccgggcggcgttggtggttcaaacctttaaccttgattttatagggaagggaattgagcgtcaggtcgataatatcgccgatgtctatggttttactgtttttgaccttcgagccgtttacttgaaccctacccagttcgatgtgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataa

SEQ ID NO: 40339 - protein, 150 aa, Neisseria meningitidis
MVLPVSFFQPVQLAAVALGRSAVGIGGSDAAELVELFALFPQCCRFRVLFIQKPRLGCRAALVVQTFNLDFIGKGIERQVDNIADVYGFTVFDLRAVYLNPTQFDVLLRKGTGLEKTCRPKPFVQPHGGRIVLVFHTILFEIIEFVSSLA

SEQ ID NO: 40340 - DNA, 408 bp, Neisseria gonorrhoeae
atggaaattcgggtaataaaatatacggcaacggctgcgttgtttgcatttacggttgcaggctgccggctggcggggtggtatgagtgtttgtccttgtccggctggtgtaagccgagaaaacctgccgccatcgatttttgggatattggcggcgagagtccgctgtctttagaggactacgagataccgctttcagacggcaatcgttccgtcagggcaaacgaatatgaatccgcgcaaaaatcttacttttataggaaaatagggaagtttgaagcctgcgggttggattggcgtacgcgtgacggcaaacctttggttgagaggttcaaacaggaaggtttcgactgtttggaaaagcaggggttgcggcgcaacggcctgtccgagcgcgtccgatggtaa

SEQ ID NO: 40341 - protein, 135 aa, Neisseria gonorrhoeae
MEIRVIKYTATAALFAFTVAGCRLAGWYECLSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 40342 - DNA, 362 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatagttccgtcagggcaaacgaatatgaatccgcacaacaatcttacttttacaggaaaatagggaagtttgaagctgcgggctggattggcgtacgcgtgacggcaaacctttgattgagacgttcaaacagggaggatttgactgcttggaaaag

SEQ ID NO: 40343 - protein, 121 aa, Neisseria meningitidis
  misc_feature (94)..(94): Xaa can be any naturally occurring amino acid
MEIRAIKYTAMAALLAFTVAGCRLAGWYECSSLTGWCKPRKPAAIDFWDIGGESPPSLGDYEIPLSDGNSSVRANEYESAQQSYFYRKIGKFEXCGLDWRTRDGKPLIETFKQGGFDCLEK

SEQ ID NO: 40344 - DNA, 408 bp, Neisseria meningitidis
atggaaattcgggcaataaaatatacggcaatggctgcgttgcttgcatttacggttgcaggctgccggttggcaggttggtatgagtgttcgtccctgtccggctggtgtaagccgagaaaacctgccgccatcgatttttgggatattggcggcgagagtcctccgtctttagaggactacgagataccgctttcagacggcaatcgttccgtcagggcaaacgaatatgaatccgcacaacaatcttacttttacaggaaaatagggaagtttgaagcctgcgggttggattggcgtacgcgtgacggcaaacctttgattgagacgttcaaacaggaaggttttgattgtttgaaaaagcaggggttgcggcgcaacggtctgtccgagcgcgtccgatggtaa

SEQ ID NO: 40345 - protein, 135 aa, Neisseria meningitidis
MEIRAIKYTAMAALLAFTVAGCRLAGWYECSSLSGWCKPRKPAAIDFWDIGGESPPSLEDYEIPLSDGNRSVRANEYESAQQSYFYRKIGKFEACGLDWRTRDGKPLIETFKQEGFDCLKKQGLRRNGLSERVRW

SEQ ID NO: 40346 - DNA, 408 bp, Neisseria gonorrhoeae
atggaaattcgggtaataaaatatacggcaacggctgcgttgtttgcatttacggttgcaggctgccggctggcggggtggtatgagtgttcgtccttgtccggctggtgtaagccgagaaaacctgccgccatcgatttttgggatattggcggcgagagtccgctgtctttagaggactacgagataccgctttcagacggcaatcgttccgtcagggcaaacgaatatgaatccgcgcaaaaatcttacttttataggaaaatagggaagtttgaagcctgcgggttggattggcgtacgcgtgacggcaaacctttggttgagaggttcaaacaggaaggtttcgactgtttggaaaagcaggggttgcggcgcaacggcctgtccgagcgcgtccgatggtaa

SEQ ID NO: 40347 - protein, 135 aa, Neisseria gonorrhoeae
MEIRVIKYTATAALFAFTVAGCRLAGWYECSSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 40348 - DNA, 408 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatcgttccgtcagggcaaacgaatatgaatccgcacaacaatcttacttttacaggaaaatagggaagtttgaagcctgcgggctggattggcgtacgcgtgacggcaaacctttgattgagacgttcaaacagggaggatttgactgcttggaaaagcaggggttgcggcgcaacggtctgtccgagcgcgtccgatggtaa

SEQ ID NO: 40349 - protein, 135 aa, Neisseria meningitidis
MEIRAIKYTAMAALLAFTVAGCRLAGWYECSSLTGWCKPRKPAAIDFWDIGGESPPSLGDYEIPLSDGNRSVRANEYESAQQSYFYRKIGKFEACGLDWRTRDGKPLIETFKQGGFDCLEKQGLRRNGLSERVRW

SEQ ID NO: 40350 - DNA, 408 bp, Neisseria meningitidis; identical to SEQ ID NO: 40344

SEQ ID NO: 40351 - protein, 135 aa, Neisseria meningitidis; identical to SEQ ID NO: 40345

SEQ ID NO: 40352 - DNA, 359 bp, Neisseria gonorrhoeae
atgacccatatcaaacccgtcattgccgcgctcgcactcatcgggcttgccgcctgctccggcagcaaaaccgaacagcccaagctcgactaccaaagccggtcgcaccgcctgatcaaactcgaagtcccgcctgatttgaacaaccccgaccaaggcaacctctaccgcctgcctgccggttcgggagccgtccgcgccggggatttggaaaaacgccgcacacccgccgtccaacagccagcggatgccggaagtattgaaaagcgtcaaaggcgtccgcttcgagcggcgacggcagccaacgcctggcttgtcgttgacggcaaatcccccgccgaaatctccgccgctttctg

SEQ ID NO: 40353 - protein, 119 aa, Neisseria gonorrhoeae
MTHIKPVIAALALIGLAACSGSKTEQPKLDYQSRSHRLIKLEVPPDLNNPDQGNLYRLPAGSGAVRAGDLEKRRTPAVQQPADAGSIEKRQRRPLRAATAANAWLVVDGKSPAEISAAF

SEQ ID NO: 40354 - DNA, 1128 bp, Neisseria meningitidis
atgacccatatcaaacccgtcattgccgcgctcgcactcatcgggcttgccgcctgctccggcagcaaaaccgaacagcccaagctcgactaccaaagccggtcgcaccgcctgatcaaacttgaagtcccacctgatttgaacaaccccgaccaaggcaacctctaccgcctgcctgccggttcgggcgccgtccgcgccagcgatttggaaaaacgccgcacacccgccgtccaacagcctgccgatgccgaagtattgaaaagcgtcaaaggtgtccgcctcgagcgcgacggcagccaacgctggctcgttgtcgacggcaagtctcctgccgaaatctggccgctcctgaaagccttttggcaggaaaacggcttcgacatcaaatccgaagaacccgccatcggacaaatggaaaccgagtgggcggaaaaccgcgccaaaatcccccaagacagcttgcgccgcctcttcgacaaagtcggcttgggcggcatctactccaccggcgagcgcgacaaattcatcgtccgtatcgaacagggcaaaaacggcgtttccgacatcttcttcgcccacaaagccatgaaagaagtgtacggcggcaaagacaaagacacgaccgtatggcagccctccccgtccgatcccaacctcgaagccgctttcctgacgcgctttatgcaatatttgggcgttgacggacagcaggcggaaaacgcatcggcaaaaaaacctacccttcccgccgccaacgaaatggcgcgtatcgaaggcaaaagcctgattgtctttggcgactacggcagaaactggcggcgcaccgtgctcgccctcgaccgcatcgggctgaccgtcgtcggtcaaaacaccgaacgccacgccttcctggttcaaaaagccccgaacgaaagcaatgcagttaccgaacaaaaacccggcctgttcaaacgcctgctgggcaaaggcaaagcggagaaacctgccgaacagccggaactgattgtctatgcagaacctgtcgccaacggctcgcgcatcgtcctgctcaacaaagacggcagcgcatatgccggcaaagacgcatccgcattattgggcaaactccattccgaactgcgttaa

SEQ ID NO: 40355 - protein, 375 aa, Neisseria meningitidis
MTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSPAEIWPLLKAFWQENGFDIKSEEPAIGQMETEWAENRAKIPQDSLRRLFDKVGLGGIYSTGERDKFIVRIEQGKNGVSDIFFAHKAMKEVYGGKDKDTTVWQPSPSDPNLEAAFLTRFMQYLGVDGQQAENASAKKPTLPAANEMARIEGKSLIVFGDYGRNWRRTVLALDRIGLTVVGQNTERHAFLVQKAPNESNAVTEQKPGLFKRLLGKGKAEKPAEQPELIVYAEPVANGSRIVLLNKDGSAYAGKDASALLGKLHSELR

SEQ ID NO: 40356 - DNA, 1128 bp, Neisseria meningitidis
atgacccatatcaaacccgtcattgccgcgctcgcactcatcgggcttgccgcctgctccggcagcaaaaccgaacagcccaagctcgactaccaaagccggtcgcaccgcctgatcaaactcgaagtcccacctgatttgaacaaccccgaccaaggcaacctctaccgcctgcctgccggttcgggcgccgtccgcgccagcgatttggaaaaacgccgcacacccgccgtccaacagcctgccgatgccgaagtattgaaaagcgtcaaaggtgtccgcctcgagcgcgacggcagccaacgctggctcgttgtcgacggcaagtctcatgccgaaatctggccgctcctgaaagccttttggcaggaaaacggcttcgacatcaaatccgaagaacccgccatcggacaaatggaaaccgagtgggcggaaaaccgtgccaaaatcccccaagacagcttgcgccgcctattcgacacagtcggtttgggcggcatctactccaccggcgagcgcgacaaattcatcgtccgtatcgaacagggcaaaaacggcgtttccgacatcttcttcgcccacaaagccatgaaagaagtgtacggcggcaaagacaaagacacgaccgtatggcagccctccccgtccgatcccaacctcgaagccgctttcctgacgcgctttatgcaatatttgggcgttgacggacagcaggcggaaaacgcatcggcaaaaaaacctacccttcccgccgccaacgaaatggcgcgtatcgaaggcaaaagcctgattgtctttggcgactacggcagaaactggcggcgcaccgcgctcgccctcgaccgcatcgggctgaccgtcgtcggtcaaaacaccgaacgccacgctttcctggttcaaaaagccccgaacgaaagcaatgcagttaccgaacaaaaacccggcctgttcaaacgcctgctgggcaaaggcaaagcggagaaacctgccgaacagccggaactgattgtctatgccgagcctgtcgccaacggctcgcgcatcgtcctgctcaacaaagacggcagcgcatatgccggcaaagacgcatccgcattattgggcaaactccattccgaactgcgttaa

SEQ ID NO: 40357 - protein, 375 aa, Neisseria meningitidis
MTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSHAEIWPLLKAFWQENGFDIKSEEPAIGQMETEWAENRAKIPQDSLRRLFDTVGLGGIYSTGERDKFIVRIEQGKNGVSDIFFAHKAMKEVYGGKDKDTTVWQPSPSDPNLEAAFLTRFMQYLGVDGQQAENASAKKPTLPAANEMARIEGKSLIVFGDYGRNWRRTALALDRIGLTVVGQNTERHAFLVQKAPNESNAVTEQKPGLFKRLLGKGKAEKPAEQPELIVYAEPVANGSRIVLLNKDGSAYAGKDASALLGKLHSELR

SEQ ID NO: 40358 - DNA, 300 bp, Neisseria gonorrhoeae
atgagtgcgagcgcggcaatgacgggtttgatatgggtcatcgtgtcatcctgtgtgatggatattaaagtgtttgtcatgttatgccgtccgaacggttcagacggcatggctatatttaaagttgtcctgaggctttcagggcggcgcggacttttgcctgtccgccttccgtcagcggaacgagcggcaggcgcacgtgcggtccgcatccgcccaaggcggataccgcccatttcggtgcggcgggactgggttcgcagaacatggtgtcgtaaatcggaatcagccggtcgttga

SEQ ID NO: 40359 - protein, 99 aa, Neisseria gonorrhoeae
MSASAAMTGLIWVIVSSCVMDIKVFVMLCRPNGSDGMAIFKVVLRLSGRRGLLPVRLPSAERAAGARAVRIRPRRIPPISVRRDWVRRTWCRKSESAGR

SEQ ID NO: 40360 - DNA, 300 bp, Neisseria meningitidis
wtgagtgcgagcgcggcaatgacgggtytgatatgggtcatcgtgtcatcstgtgtgatggatattaaagtgtytgttgcgwtatgccgtccgaacggttcggacggcatggmtatatttaaagttgtcctgaggctttcagggcggcgcggactkttgcwtgtccgtttyccgtcagcggaacgagcggcaggcggacgtgcggttcgcatctgcccagggcggataccgcccatttcggtgcggcggggctgggttcgcagaacatggtgtcgtaaatcggaatcagtcggtcgttga

SEQ ID NO: 40361 - protein, 99 aa, Neisseria meningitidis
  misc_feature (1)..(1): Xaa can be any naturally occurring amino acid
  misc_feature (25)..(25): Xaa can be any naturally occurring amino acid
  misc_feature (28)..(28): Xaa can be any naturally occurring amino acid
  misc_feature (38)..(38): Xaa can be any naturally occurring amino acid
  misc_feature (54)..(54): Xaa can be any naturally occurring amino acid
XSASAAMTGLIWVIVSSCVMDIKVXVAXCRPNGSDGMXIFKVVLRLSGRRGLLXVRFPSAERAAGGRAVRICPGRIPPISVRRGWVRRTWCRKSESVGR

SEQ ID NO: 40362 - DNA, 300 bp, Neisseria meningitidis
atgagtgcgagcgcggcaatgacgggtttgatatgggtcatcgtgtcatcctgtgtgatggatattaaagtgtttgttgcgttatgccgtccgaacggttcggacggcatggctatatttaaagttgtcctgaggctttcagggcggcgcggacttttgcctgtccgccttccgtcagcggaacgagcggcaggcggacgtgcggttcgcatctgcccagggcggataccgcccatttcggtgcggcggggctgggttcgcagaacatggtgtcgtaaatcggaatcagccggtcgttga

SEQ ID NO: 40363 - protein, 99 aa, Neisseria meningitidis
MSASAAMTGLIWVIVSSCVMDIKVFVALCRPNGSDGMAIFKVVLRLSGRRGLLPVRLPSAERAAGGRAVRICPGRIPPISVRRGWVRRTWCRKSESAGR

SEQ ID NO: 40364 - DNA, 489 bp, Neisseria gonorrhoeae
atgaccgccctactcgtcatcctcgccctcgccctgatagccgtcggcacggcaggcatcgtctatcccgccctgcccggcttggcattgatgtttgccggaacatggctgcttgcctatgccggcggctatcaaatctacggcgcaggcatcttgtggacggtcggactcatcagccttggcggcatactggcggactatatggcaggcatgttgggggtaaaatacactggggcaggcaaactcgccgtccgaggtgcattggccggcagcatcatcggcatatttttctcccttcccggactaatactcggcccctttatcggcgcggcggcaggcgaactgatcgatcggcgcaatatgcttcaggcaggtaaagcgggcttgggtacgctgttggggcttgtcgtcggcacggcgttcaaaatcggctgcgccgtatccatcttgtttatcctgttggtgaaatacatcgcatacctgttttaa

SEQ ID NO: 40365 - protein, 162 aa, Neisseria gonorrhoeae
MTALLVILALALIAVGTAGIVYPALPGLALMFAGTWLLAYAGGYQIYGAGILWTVGLISLGGILADYMAGMLGVKYTGAGKLAVRGALAGSIIGIFFSLPGLILGPFIGAAAGELIDRRNMLQAGKAGLGTLLGLVVGTAFKIGCAVSILFILLVKYIAYLF

SEQ ID NO: 40366 - DNA, 489 bp, Neisseria meningitidis
  misc_feature (438)..(438): n is a, c, g, or t
atgaccgtactgaccgtcatcctcgccctcgccctgatagccgtcggcacggcgggcatcgtttaccccgccctgcccggattggcattgatgtttgccggaacatggctgcttgcctatgccggcggctaccaaatctacggcgcgggcgttttgtggacggtcggactcatcagccttgccggcatactggcggactatgtggcaggcatatgggggacaaaatataccggagcgggcaagctcgccgttcgcggcgcattggccggcagcatcatcggcatatttttctcccttcccggactaatactcggtccctttatcggcgcggcggcaggcgaactgatcgaacggcgcaatatgcttcaggcaggtaaagcgggcttgggtacgctgttggggcttgtcgtcggcacggcgttcaaaatcggctgcgcngtatccatcttgtttatcctgttggtgaaatacatcgcctacctgttttaa

SEQ ID NO: 40367 - protein, 162 aa, Neisseria meningitidis
MTVLTVILALALIAVGTAGIVYPALPGLALMFAGTWLLAYAGGYQIYGAGVLWTVGLISLAGILADYVAGIWGTKYTGAGKLAVRGALAGSIIGIFFSLPGLILGPFIGAAAGELIERRNMLQAGKAGLGTLLGLVVGTAFKIGCAVSILFILLVKYIAYLF

SEQ ID NO: 40368 - DNA, 489 bp, Neisseria meningitidis
atgaccgccttgctcgtcatcctcgccctcgccctgatagccgccggtacggcgggcatcgtttaccccgccctgcccggattggcattgatgtttgccggaacctggctgctcgcctactccggcggctaccaaatctacggcgcgggcgttttgtggacggtcggactcatcagccttgccggcatactggcggactatgtggcaggcatatgggggacaaaatataccggagcgggcaagctcgccgttcgcggcgcattggccggcagcatcatcggcatatttttctcccttcccggactaatactcggtccctttatcggcgcggcggcaggcgaactgatcgaacggcgcaatatgcttcaggcaggtaaagcgggcttgggtacgctgttggggcttatcgtcggtacggcgttcaaaatcggctgcgccgtatccatcttgtttatcctgttggtgaaatacatcgcctacctgttttaa

SEQ ID NO: 40369 - protein, 162 aa, Neisseria meningitidis
MTALLVILALALIAAGTAGIVYPALPGLALMFAGTWLLAYSGGYQIYGAGVLWTVGLISLAGILADYVAGIWGTKYTGAGKLAVRGALAGSIIGIFFSLPGLILGPFIGAAAGELIERRNMLQAGKAGLGTLLGLIVGTAFKIGCAVSILFILLVKYIAYLF

SEQ ID NO: 40370 - DNA, 330 bp, Neisseria gonorrhoeae
atggctgaaacaatgaaaaaacaggcggattcgcctgatttggtgtacggtttggaagacaggccgccgttcggtaatgcgctcttgagcgcggttacccatcttttggcgattttcgtgccgatgattacgcccgcgctgattgtgggcggcgcgctggaattgccggtggagatgacggcgtatctggtgtcgatggcgatggttgcgtcgggtgtcggcacttatttgcaggtcaaccgcttcgggtcggtcggctcggggatgctgtccatccagcgttaccgtcatgattgcgctcggcgcggggatgaaagagggcggtttgag

SEQ ID NO: 40371 - protein, 110 aa, Neisseria gonorrhoeae
MAETMKKQADSPDLVYGLEDRPPFGNALLSAVTHLLAIFVPMITPALIVGGALELPVEMTAYLVSMAMVASGVGTYLQVNRFGSVGSGMLSIQRYRHDCARRGDERGRFE

SEQ ID NO: 40372 - DNA, 1392 bp, Neisseria meningitidis
atgagcggtcagttgggcaaaggtgcggatgcgcctgatttggtgtacggtttggaagacaggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttttcgttcgttaccgtgatgattgcgctgggcgcggggatgaaagagggcggtttgactaaggatgcgatgatttcgacgctcttgggcgtatcgtttgtcggcgcgtttttggtgtgtttctcggcgtggcttctgccgtatttgaaaaaagtgattacgccgacggtcagcggcgtggtcgtgatgctcattggtttgagtttggtacacgtcggcattaccgatttcggcggcggcttcggcgcgaaggcggacggcacgttcggctcgatggaaaacttggggctggcatcgctggtgttgctgattgtgttggtgttcaactgcatgaaaaacccgctgttgcgcatgagcggcattgcggtcgggctgattgccggctatatcgtcgcgctgtttttgggcaaggtggatttttccgcgctgcaaaacctgccgctggttacgctgcccgtaccgtttaaatacggttttgctttcgactggcacgcgtttattgtggcgggcgcgattttcttgttgagcgtgtttgaggcggtcggcgatttaaccgcgacggcaatggtgtccgaccagccgattgaaggcgaggaatacaccaaacgcctgcgcggcggcgtgttggctgacggcttggtgtcggtgattgcgacggctttgggttcgctgccgctgacgacgtttgcgcaaaacaacggcgtgattcagatgaccggcgtggcttcgcgccatgtgggcaaatatattgccgtgattttggtgctgttgggtctgttccccgttgtcggtcgcgcgtttacgacgattccgagtccggtgttgggcggcgcgatggttttgatgttcggcttaattgcgattgcgggcgtgcggattttggtcagtcacggcatccgcaggcgcgaagcggtgattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactga

SEQ ID NO: 40373 - protein, 463 aa, Neisseria meningitidis
MSGQLGKGADAPDLVYGLEDRPPFGNALLSAVTHLLAIFVPMITPALIVGGALELPVEMTAYLVSMAMVASGVGTYLQVNRFGPVGSGMLSIQSVNFSFVTVMIALGAGMKEGGLTKDAMISTLLGVSFVGAFLVCFSAWLLPYLKKVITPTVSGVVVMLIGLSLVHVGITDFGGGFGAKADGTFGSMENLGLASLVLLIVLVFNCMKNPLLRMSGIAVGLIAGYIVALFLGKVDFSALQNLPLVTLPVPFKYGFAFDWHAFIVAGAIFLLSVFEAVGDLTATAMVSDQPIEGEEYTKRLRGGVLADGLVSVIATALGSLPLTTFAQNNGVIQMTGVASRHVGKYIAVILVLLGLFPVVGRAFTTIPSPVLGGAMVLMFGLIAIAGVRILVSHGIRRREAVIAATSVGLGLGVAFEPEVFKNLPVLFQNSISAGGITAVLLNLVLPEDKTEAAVKFDTDHLEH

SEQ ID NO: 40374 - DNA, 1392 bp, Neisseria meningitidis
atgagcggtcagttgggcaaaggtgcggatgcgcctgatttggtgtacggtttggaggataggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttctcgttcgttaccgtcatgattgcgctcggcgcggggatgaaagagggcggtttgactaaggatgcgatgatttcgacgctcttgggcgtatcgtttgtcggcgcgtttttggtgtgtttttcggcgtggcttctgccgtatttgaaaaaagtgattacgccgacggtcagcggtgtggtggtgatgctgatcggcttgagtttggtacacgtcggtattaccgatttcggcggcggcttcggcgcaaaggcggacggcacgttcggctcgatggaaaacttggggctggcatcgctggtgctgctgattgtgctggtgttcaattgcatgaaaaacccgctgctgcggatgagcggcattgcggtcggtctgattgccggctatatcgtcgcgctgtttttgggcaaggtggatttttcggcactgcaaaacctgccgctggttacgctgcccgtaccgtttaaatatggttttgcttttgactggcacgcatttattgtggcgggtgcgattttcttgttgagcgtgtttgaggcggtcggcgatttgacggcgacggcaatggtgtccgaccagccgattgaaggcgaggaatacaccaaacgcttgcgcggcggcgtgttggcggacggcttggtgtcggtgattgcgacggctttgggttcgctgccgctgacgacgtttgcacaaaacaacggcgtgattcagatgaccggcgtggcttcgcgccatgtgggcaaatatattgccgtgattttggtgctgttgggtctgttccccgttgtcggacgcgcgtttacgacgattccgagtccggtgttgggcggcgcgatggttttgatgttcggcttgattgcgattgcgggcgtgcggattttggtcagccacggcatccgcaggcgcgaagcggtaattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactga

SEQ ID NO: 40375 - protein, 463 aa, Neisseria meningitidis; identical to SEQ ID NO: 40373

SEQ ID NO: 40376 - DNA, 789 bp, Neisseria gonorrhoeae
  misc_feature (25)..(25): n is a, c, g, or t
  misc_feature (35)..(35): n is a, c, g, or t
atgccctttcccgttttcagacaantatttgcttngtccttgctacggttttttgccgtaggtcggattctcgaatccgacatttccaacagcggtttttcggaaacgataaacgcgtcaaatgttttttttgtcggatacgaatatccggcctgcatttcaaatttacatcgcttccaatttcgcaaacttggtatccagttctttcacgccctgtttgccgaagttgatggtcagtcgggcggattcgcctttgtctgcggcatcgataatcacgccggtgccgaatttggcgtgacggacgttttgtccgatgcggaagcctgcgtaggtttgcggctgtttgaagtcatcgatgattttgtcccgttgtacggtggtttggcgcgtgttgccgtagctgtcgaaggcgggttttttgacggacaggtagtgcaatacttctggcgggatttcttcgacgaagcgggatgcgatgccgaattgggtttgtccgtgcagcatgcgttgctgtgccatggtgatgtagaggcgtttgcgggcgcgggtgatggcgacgtacatgaggcggcgttcttcttcgaggccgccgcgctcggcaaggctcatttcgctggggaaacgcccctcttccataccggtgaggaagacggcgttgaattccaagcctttggcggcgtggacggtcatcagttggacggctttttcgcctgcccctgcttggttttcgccggattcgagggcggcgttgctcaagaaggcgaggatggggaaggcgggatcgtctga

SEQ ID NO: 40377 - protein, 262 aa, Neisseria gonorrhoeae
  misc_feature (9)..(9): Xaa can be any naturally occurring amino acid
  misc_feature (12)..(12): Xaa can be any naturally occurring amino acid
MPFPVFRQXFAXSLLRFFAVGRILESDISNSGFSETINASNVFFVGYEYPACISNLHRFQFRKLGIQFFHALFAEVDGQSGGFAFVCGIDNHAGAEFGVTDVLSDAEACVGLRLFEVIDDFVPLYGGLARVAVAVEGGFFDGQVVQYFWRDFFDEAGCDAELGLSVQHALLCHGDVEAFAGAGDGDVHEAAFFFEAAALGKAHFAGETPLFHTGEEDGVEFQAFGGVDGHQLDGFFACPCLVFAGFEGGVAQEGEDGEGGIV

SEQ ID NO: 40378 - DNA, 786 bp, Neisseria meningitidis
atgccctttcccgttttcagacggccttttgctttgtccttacttacgttttttgccgtaagtcagattcttgtatccgacatttccaacagcggtgtttcggaaacaatagacgcgtcaaatgtttttgtcggatacgaatatccgacctacatttcaaatttacatctcttccaatttcgcaaacttggtgtccaactctttcacgccctgtttgccgaaattgatggtcagtcgggcggattcgcctttatctgcggcatcgataatcacgccggtgccgaatttggcgtggcggacgttttgtccgatacggaaacctgcgtaggtttggggctgtttgtagtcgtcgatgattttatctttggatgcggcggtttggcgcgtgttgccgtaactgtcgtaggcaggctttttgacggacaggtagtgcaatacttcgggtgggatctcttcgacgaagcgggagacgatgccgaattgggtttgtccgtgcagcatgcgttgttgcgccatggtgatgtagaggcgtttgcgggcgcgggtgatggcgacgtacatgaggcggcgttcttcttcgaggccgccgcgttcggcaaggctcatttcgctggggaagcggccttcttccatgccggtgaggaagacggcgttaaattccaagcctttggcggcgtggacggtcatgagttggacggccttttcgcctgcgcctgcctggttttcaccggattcgagggcggcattgcttaggaaggcgagaatggggaaggcggggtcgtctga

SEQ ID NO: 40379 - protein, 261 aa, Neisseria meningitidis
  misc_feature (251)..(251): Xaa can be any naturally occurring amino acid
MPFPVFRRPFALSLLTFFAVSQILVSDISNSGVSETIDASNVFVGYEYPTYISNLHLFQFRKLGVQLFHALFAEIDGQSGGFAFICGIDNHAGAEFGVADVLSDTETCVGLGLFVVVDDFIFGCGGLARVAVTVVGRLFDGQVVQYFGWDLFDEAGDDAELGLSVQHALLRHGDVEAFAGAGDGDVHEAAFFFEAAAFGKAHFAGEAAFFHAGEEDGVKFQAFGGVDGHELDGLFACACLVFTGFEGGIAXEGENGEGGVV

SEQ ID NO: 40380 - DNA, 771 bp, Neisseria meningitidis
ttcagacggccttttgccttgtccttgctacagttttttgccataggtcggattctcgaatccgacatttccaacagcggtttttcggaaacgatagacgcgtcaaatatttttgtcggatacgagtatccagcctgcatttcaaatttacatcgcttccaatttcgcaaacttggtgtccaactctttcacgccctgtttgccgaaattgatggtcagtcgggcggattcgcctttatctgcggcatcgataatcacgccggtgccgaatttggcgtggcggacgttttgtccgatacggaaacctgcgtaggtttggggctgtttgtagtcgtcgatgattttgtctttgggcgcggcggtttggcgcgtgttgccatagcggtcgtaggcgggttttttgacggacaggtagtgcaatacttcgggcgggatttcttcgacgaagcgggagacgatgccgaattgggtttgtccgtgcagcatgcgttgttgcgccatggtgatgtagaggcgtttgcgggcgcgggtgatggcgacgtacatcaggcggcgttcttcttcgaggccgccgcgttcggcaaggctcatttcgctggggaagcggccttcttccatgccggtgaggaatacggcgttaaattccaagcctttggcggcgtgcacggtcatgagttgtacggctttttcgcccgcgcctgcttggttttcgccggattcgagagcagcattgcttaggaaagcgaggatggggaaggcggggtcgtctga

SEQ ID NO: 40381 - protein, 255 aa, Neisseria meningitidis
FRRPFALSLLQFFAIGRILESDISNSGFSETIDASNIFVGYEYPACISNLHRFQFRKLGVQLFHALFAEIDGQSGGFAFICGIDNHAGAEFGVADVLSDTETCVGLGLFVVVDDFVFGRGGLARVAIAVVGGFFDGQVVQYFGRDFFDEAGDDAELGLSVQHALLRHGDVEAFAGAGDGDVHQAAFFFEAAAFGKAHFAGEAAFFHAGEEYGVKFQAFGGVHGHELYGFFARACLVFAGFESSIAESEDGEGGVV

SEQ ID NO: 40382 - DNA, 1281 bp, Neisseria gonorrhoeae
atgaaatccctttttatttggctgcttctattgggctcggcggcaggcgttttctaccatacccaaaaccaatccctgcccgcgggcgaacttgtctatccgtccgcaccgcaaatcagggacggcggcgatgcgctgcactacctcaaccgcatccgcacacaaatcggtttgcacgcgctggcacacgcgccggttttggaaaattccgcccgcaggcacgcacgctatctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaggaagccgccgaatcgtccgacagcgacatccgcacgcagcaacgccaagtggacgctttgatgagcgcaatctaccaccgcctttcgctgcttgaccgccataccgacgaagcaggtgcggcatttgtgcgcgaaaacggcaaaaccgtcctcgtattcaatcagggcaacggcagcttcgagcgcgcctgtgcaaaaggaaggcggcagccggaagcaggacggaaatattaccgcaacgcttgccacaacggtgcggccgtttatgctgacgaagccatgcccgtaacggaattgctttataccgcctatccggttggcggcggcgcgctgccttatttttacggggaacgtcccgaccccgtgccggaatatgaaatcacaggcaatcctgccagcattgatttttccgaggcggcaggcaaaattgcgatgaaaagtttcaagctgtatcagggtaaaaacgaaatccgccccgtcagggttttaaccgccggcaacgaccctaacggcaggctgaccgcgcaccaattcgcccttttcccgctcaaacctttggaatacggcacgctttatacggcggtattcgactatgtccgcaacggacggcacgcgcaggcgaaatggcagtttagaacccgaaaacccgattacccttattttgaggtaaacggcggcgagacacttgcggttagaaaaggcgaaaaatatttcatccactggcgcggacgctggtgtctggaagcgtgtacccgttatacctaccggcggcagttcggcaacagcctgtccatactccggcacgaagcgggcggcattgtcttcagcgtcagcggaatggcgggaagccgcatcaggcttactccggaagacagcccggaacgcggtgtaaccctttatttgcaggattga

SEQ ID NO: 40383 - protein, 426 aa, Neisseria gonorrhoeae
MKSLFIWLLLLGSAAGVFYHTQNQSLPAGELVYPSAPQIRDGGDALHYLNRIRTQIGLHALAHAPVLENSARRHARYLTLNPEDGHGEHHPDNPHYTAQKLTERTRLAGYLYNGVHENISTEEEAAESSDSDIRTQQRQVDALMSAIYHRLSLLDRHTDEAGAAFVRENGKTVLVFNQGNGSFERACAKGRRQPEAGRKYYRNACHNGAAVYADEAMPVTELLYTAYPVGGGALPYFYGERPDPVPEYEITGNPASIDFSEAAGKIAMKSFKLYQGKNEIRPVRVLTAGNDPNGRLTAHQFALFPLKPLEYGTLYTAVFDYVRNGRHAQAKWQFRTRKPDYPYFEVNGGETLAVRKGEKYFIHWRGRWCLEACTRYTYRRQFGNSLSILRHEAGGIVFSVSGMAGSRIRLTPEDSPERGVTLYLQD

SEQ ID NO: 40384 - DNA, 494 bp, Neisseria meningitidis
atgaaatccctttttattcggctgctcctgttgggttcggcggcaggcgttttctaccatacccaaamccaatccctgcccgcgggcgaacttgtctatccgtccgcaccgcaaatcagggacggcggcgatgcgctgcactacctcaaccgcatccgagcccaaatcggtttgcacaagctggcacacgcgccggttttggaaaactccgcccgcaggcacgcaagctacctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaagaagccgccgaatcgtccgacagcgacatccgcacgcagcaacgccaagtggacggattaatgagcgcaatctaccaccgcctttccctacttgaccgccatacggatgagtcaggagcggcatt

SEQ ID NO: 40385 - protein, 164 aa, Neisseria meningitidis
  misc_feature (23)..(23): Xaa can be any naturally occurring amino acid
MKSLFIRLLLLGSAAGVFYHTQXQSLPAGELVYPSAPQIRDGGDALHYLNRIRAQIGLHKLAHAPVLENSARRHASYLTLNPEDGHGEHHPDNPHYTAQKLTERTRLAGYLYNGVHENISTEEEAAESSDSDIRTQQRQVDGLMSAIYHRLSLLDRHTDESGAA

SEQ ID NO: 40386 - DNA, 1281 bp, Neisseria meningitidis
atgaaatccctttttattcggctgctcctgttgggttcggcggccggcgttttctatcatacccaaaaccaatccctgcccgcgggcgaacttgtctatccgtccgcaccgcaaatcagggacggcggcgatgcgctgcactacctcaaccgcatccgcgcccaaatcggtttgcacaagctggcacacgcgccggttttggaaaattccgcccgcaggcacgcacgctatctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaggaagccgccgaatcgtccgacagcgacatccgcacgcagcaacgccaagtggacggattaatgagcgcaatctaccaccgcctttccctacttgaccgccatacggatgaggcaggagcggcatttgtgcgcgaaaacggtaaaaccgttctcgtattcaatcagggcaacggcaggtttgagcggcattgcgcccaaggcagaaatcagccggaagcaggacggaaatattaccgcaacgcctgccataacggtgcggtcgtgtacaccgacgaagccatgcccgcacaggagctgctctatacagcctatcccgtcggcaacggcgcactgccttatttccacggcgagcgtccagaccccgtgccggaatatgaaatcacgggcaatcctgccagcattgatttttccgaggcggcaggcaaaattacgatgaaaagtttcaagctgtatcagggtaaaaacgaaatccgccccgtcagggttttaaccgccggcaacgaccccaacggcaggctgaccgcgtaccaattcgcgcttttcccgctcaagcctttggaatacggtacgctttatacggcggtattcgactatgtccgcaacggacggcgcgcgcaggcgaaatggcagtttagaacccgaaaacccgattacccttattttgaggtaaacggcggcgagacacttgcggttagaaaaggcgaaaaatatttcatccactggcgcggacgctggtgtttggaagcgtgtacccgttatacctaccggcagcgacccggcagccgcctgtccataggaaggcacaaggcgggcggcatcgtcttcagcgttgacggaatggcgggcagccgcatcacgcttgcaccggaaggagaaacggaacgaggcgtaaccctttatttacaggattga

SEQ ID NO: 40387 - protein, 426 aa, Neisseria meningitidis
MKSLFIRLLLLGSAAGVFYHTQNQSLPAGELVYPSAPQIRDGGDALHYLNRIRAQIGLHKLAHAPVLENSARRHARYLTLNPEDGHGEHHPDNPHYTAQKLTERTRLAGYLYNGVHENISTEEEAAESSDSDIRTQQRQVDGLMSAIYHRLSLLDRHTDEAGAAFVRENGKTVLVFNQGNGRFERHCAQGRNQPEAGRKYYRNACHNGAVVYTDEAMPAQELLYTAYPVGNGALPYFHGERPDPVPEYEITGNPASIDFSEAAGKITMKSFKLYQGKNEIRPVRVLTAGNDPNGRLTAYQFALFPLKPLEYGTLYTAVFDYVRNGRRAQAKWQFRTRKPDYPYFEVNGGETLAVRKGEKYFIHWRGRWCLEACTRYTYRQRPGSRLSIGRHKAGGIVFSVDGMAGSRITLAPEGETERGVTLYLQD

SEQ ID NO: 40388 - DNA, 1100 bp, Neisseria gonorrhoeae
atgtcaggtagaacaggacggaacagtgccactcaggcgcaaccggaacgcgtcatgctggtgggcgtaatgttggataaagatgatacgggcagcaatgccgcccgtctgaacggttttcagacggcattggcggaagccgtcgagctggtcaaagcggcgggcggcgattccgtacgcgtggagactgccaaacgcgaccgcccgcacactgcgctgtttgtcggcacgggcaaggcggcggagctgtcggaagcagttgccgcagacggcattgatttggtcgtattcaaccacgaacttactcccacgcaggaacgcaatttggaaaaaatcctccaatgccgcgtattggacagagtggggctgattctggcgattttcgcccgccgcgcccgcacgcaggaaggcaggctgcaagtcgagttggcgcaattgagccatttggcgggacgcttgatacgcggttacggacatttgcaaagccagcgcggcggtatcggcatgaaagggccgggcgaaaccaaactggaaaccgaccgccgattaaccgcccatcggatcaacgccttgaaaaaacagcttgccaacctcaaaaaacagcgcgccctgcgccgcaagtcccgcgagtcgggcagaatcaaaacgtttgcgctggtcggctataccaatgtcggcaaatccagcctgttcaaccggctgaccaagtcgggcatatatgcgaaagaccagcttttcgccactctcgacacgacggcgcggcggctgtacatcagtcccgcatgcagcattatcctgaccgataccgtcggattcgtcagcgatctgccgcacaaactgatttccgccttttccgccaccttggaagaaaccgtgcaagccgatgtgctgctgcacgtcgtcgatgctgccgcccggaacagcgggcagcagattgaagacgtggaaaacgtactgcaagaaatccatgcccacgatattccgtgcatcaaggtgtacaacaaaaccgacctgctgccgtctgaagaacaaaacacgggcatatggcgcgacgctgcgggaaaaattgccgccgtccgcatttccgttgctgaaaatac

SEQ ID NO: 40389 - protein, 392 aa, Neisseria gonorrhoeae
MSGRTGRNSATQAQPERVMLVGVMLDKDDTGSNAARLNGFQTALAEAVELVKAAGGDSVRVETAKRDRPHTALFVGTGKAAELSEAVAADGIDLVVFNHELTPTQERNLEKILQCRVLDRVGLILAIFARRARTQEGRLQVELAQLSHLAGRLIRGYGHLQSQRGGIGMKGPGETKLETDRRLTAHRINALKKQLANLKKQRALRRKSRESGRIKTFALVGYTNVGKSSLFNRLTKSGIYAKDQLFATLDTTARRLYISPACSIILTDTVGFVSDLPHKLISAFSATLEETVQADVLLHVVDAAARNSGQQIEDVENVLQEIHAHDIPCIKVYNKTDLLPSEEQNTGIWRDAAGKIAAVRISVAENTGIDALREAIAEYCAAAPNTDETEMP

SEQ ID NO: 40390 - DNA, 1139 bp, Neisseria meningitidis
  misc_feature (624)..(624): n is a, c, g, or t
  misc_feature (780)..(780): n is a, c, g, or t
atgacaggcagaacaggcggcaacggcagtacccaagcgcaacccgaacgcgtcatgctggtgggcgtaatgttggacaaagatggtacgggcagtagtgccgcccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcagaagcagttgccgcagacggcatcgatttggtcgtattcaaccacgaactcacgcccacgcaggaacgcaaccttgaaaaagaactsaaatgccgcgtattggacagggtagggctgattctggcgattttcgctcgccgcgcccgcacgcaggaaggcaggctgcaagtcgagttggcgcaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgataaaacagcttgccaacctcaaaaaacagcgcgccctgcgccgcaagtcncgcgaatcgggcacaatcaaaacgtttgcgctggtcggctatacaaatgtcggaaaatccagcctgttcaaccggctgacaaagtcgggcatatatgcaaaggacaagcttagtcccgaatgcagcattatcctgaccgataccgtcggattcgtnagcgatctgccgcacaaactgatttccgccttttcgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtcttgtgccgccgcaccaaacacagacgaaaccgaaatgccatga

SEQ ID NO: 40391 - protein, 379 aa, Neisseria meningitidis
  misc_feature (273)..(273): Xaa can be any naturally occurring amino acid
MTGRTGGNGSTQAQPERVMLVGVMLDKDGTGSSAARLNGFQTALAEAVELVKAAGGDSVRVETAKRDRPHTALFVGTGKAAELSEAVAADGIDLVVFNHELTPTQERNLEKELKCRVLDRVGLILAIFARRARTQEGRLQVELAQLSHLAGRLIRGYGHLQSQRGGIGMKGPGETKLETDRRLIAHRINALIKQLANLKKQRALRRKSRESGTIKTFALVGYTNVGKSSLFNRLTKSGIYAKDKLSPECSIILTDTVGFVSDLPHKLISAFSXTLEETAQADVLLHVVDAAAPNSGQQIEDVENVLQEIHAGDIPCIKVYNKTDLLPSEEQNTGIWRDAAGKIAAVRISVAENTGIDALREAIAESCAAAPNTDETEMP

SEQ ID NO: 40392 - DNA, 1179 bp, Neisseria meningitidis
atgacaggcagaacaggccgcaacggcagtacccaagcgcaacccgaacgcgtcatgctggtgggcgtaatgttggacaaagatggtacgggcagcagtgccacccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcggaagcagttgccgcagacggcatcgatttggtcgtattcaaccacgaacttacgcccacgcaggaacgcaatttggaaaaaatcctccaatgccgcgtattggacagagtggggctgattctggcgattttcgcccgccgcgcccgcacgcaggaaggcaggctgcaagtcgagttggcacaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgaaaaaacagcttgccaacctcaaaaaacagcgcgccctgcgccgcaagtcccgcgaatcgggcacaatcaaaacgtttgcgctggtcggctataccaatgtcggcaaatccagtctgttcaaccggctgaccaagtcgggcatatatgcgaaagaccagcttttcgccacactcgacacgacggcgcggcggctgtacatcagtcccgaatgcagcattatcctgaccgataccgtcggattcgtcagcgatctgccgcacaaactgatttccgccttttccgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtattgtgccgccgcaccaaacacagacgaaaccgaaatgccatga

SEQ ID NO: 40393 - protein, 392 aa, Neisseria meningitidis
MTGRTGRNGSTQAQPERVMLVGVMLDKDGTGSSATRLNGFQTALAEAVELVKAAGGDSVRVETAKRDRPHTALFVGTGKAAELSEAVAADGIDLVVFNHELTPTQERNLEKILQCRVLDRVGLILAIFARRARTQEGRLQVELAQLSHLAGRLIRGYGHLQSQRGGIGMKGPGETKLETDRRLIAHRINALKKQLANLKKQRALRRKSRESGTIKTFALVGYTNVGKSSLFNRLTKSGIYAKDQLFATLDTTARRLYISPECSIILTDTVGFVSDLPHKLISAFSATLEETAQADVLLHVVDAAAPNSGQQIEDVENVLQEIHAGDIPCIKVYNKTDLLPSEEQNTGIWRDAAGKIAAVRISVAENTGIDALREAIAEYCAAAPNTDETEMP

SEQ ID NO: 40394 - DNA, 1149 bp, Neisseria gonorrhoeae
atggaggatctgcaggaaatcgggttcgatgtcgccgccgtaaaggtaggtcggcagcgcgaacatcatcgtctgcatcatacccagtccggcaacggcaaggcggacgatgtattgtttgcgttctttttggttggcggcttcgattttttgcgcgtcatagggtgcggcggtgtagcctgtctgccggattttcaacagaatgtcggagaggcggattttgccgtcgtcccagacgacgcggcagcggtgcgtgctgtaattgaggtcgatgcggacgatgccgtctgtgcgcaaaagctgctgttcgatcagccagacgcaggcggcgcaggtaatgccgctgagcatcagcactgcttcgtgcgtgccattatgggtttccacaaagtcggattggacttcgggcaggtcgtacaggcggatttggtcgaggatttcttggggcggcagttcggtttttttcgcgtcggcggtgcgtcgtttgtaataactgcccaagccggaatcgatgatgctttgtgcgactgcctgacagccgacgcagcaggtttcgcggtcttcgccttcgtagcggacggtcagatgcaggttttcgggaacgtccagcccgcagtggaaacaggtttttttcatggcatttcggtttcgtctgtgtttggtgcggcggcacaatactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgtgggcatggatttcttgcagtacgttttccacgtcttcaatctgctgcccgctgttccgggcggcagcatcgacgacgtgcagcagcacatcggcttgcacggtttcttccaaggtggcggaaaaggcggaaatcagtttgtgcggcagatcgctgacgaatccgacggtatcggtcaggataatgctgcatgcgggactgatgtacagccgccgcgccgtcgtgtcgagagtggcgaaaagctggtctttcgcatatatgcccgacttggtcagccggttgaacaggctggatttgccgacattggtatag

SEQ ID NO: 40395 - protein, 382 aa, Neisseria gonorrhoeae
MEDLQEIGFDVAAVKVGRQREHHRLHHTQSGNGKADDVLFAFFLVGGFDFLRVIGCGGVACLPDFQQNVGEADFAVVPDDAAAVRAVIEVDADDAVCAQKLLFDQPDAGGAGNAAEHQHCFVRAIMGFHKVGLDFGQVVQADLVEDFLGRQFGFFRVGGASFVITAQAGIDDALCDCLTADAAGFAVFAFVADGQMQVFGNVQPAVETGFFHGISVSSVFGAAAQYSAMASRSASIPVFSATEMRTAAIFPAASRHMPVFCSSDGSRSVLLYTLMHGISWAWISCSTFSTSSICCPLFRAAASTTCSSTSACTVSSKVAEKAEISLCGRSLTNPTVSVRIMLHAGLMYSRRAVVSRVAKSWSFAYMPDLVSRLNRLDLPTLV

SEQ ID NO: 40396 - DNA, 1035 bp, Neisseria meningitidis
  misc_feature (992)..(992): n is a, c, g, or t
atggaggatttgcaggaaatcgggttcgatgtcgccgccgtaaaggtaggtcggcagcgcgaacatcatcgtctgcatcatccccagcccggcaacggcgaggcggacgatgtattgtttgcgttctttttggttggcggcttcgattttttgcgcgtcatagggtgcggcggtgtagcctatctgcctgattttcaacagaatgtcggaaaggcggattttgccgtcgtcccagacgacgcggcagcggtgcgtgctgtaattgaggtcgatgcggacgatgccgtctgtacgcaaaagctgctgttcgatcagccagacgcaggcggcgcaggtgatgccgccgagcattaaaaccgcctcgcgcgtgccgccgtgggtttccacaaagtcggactggacttcgggcaggtcgtacaggcggatttggtcgaggatttcttggggcggcagctcggttttttgcgcgtcggcggtgcgttgtttgtaataactgcccaagcccgcgtcaataatgctttgtgcgaccgcctgacagccggcgcacagggtttcgcggtcttcgttttcgtaacggacagtcaggtggaggtgttcgggaacatccagaccgcagtggaaacaggtttttttcatggcatttcggtttcgtctgtgtttggtgcggcggcacaagactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcgaaaaggcggaaatcagtttgtgcggcagatcgctnacgaatccgacggtatcggtcaggataatgctgcattcgggac

SEQ ID NO: 40397 - protein, 344 aa, Neisseria meningitidis
  misc_feature (319)..(319): Xaa can be any naturally occurring amino acid
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDRLTAGAQGFAVFVFVTDSQVEVFGNIQTAVETGFFHGISVSSVFGAAAQDSAMASRSASIPVFSATEMRTAAIFPAASRHMPVFCSSDGSRSVLLYTLMHGISPAWISCSTFSTSSICCPLFGAAASTTCSSTSACAVSSSVAXKAEISLCGRSLTNPTVSVRIMLHSG

SEQ ID NO: 40398 - DNA, 1149 bp, Neisseria meningitidis
atggaggatttgcaggaaatcgggttcgatgtcgccgccgtaaaggtaggtcggcagcgcgaacatcatcgtctgcatcatccccagcccggcaacggcgaggcggacgatgtattgtttgcgttctttttggttggcggcttcgattttttgcgcgtcatagggtgcggcggtgtagcctatctgcctgattttcaacagaatgtcggaaaggcggattttgccgtcgtcccagacgacgcggcagcggtgcgtgctgtaattgaggtcgatgcggacgatgccgtctgtacgcaaaagctgctgttcgatcagccagacgcaggcggcgcaggtgatgccgccgagcattaaaaccgcctcgcgcgtgccgccgtgggtttccacaaagtcggactggacttcgggcaggtcgtacaggcggatttggtcgaggatttcttggggcggcagctcggttttttgcgcgtcggcggtgcgttgtttgtaataactgcccaagcccgcgtcaataatgctttgtgcgactgcctgacaaccggcgcagcaggtttcgcggtcttcgttttcgtaacggacggtcagatgcaggttttcgggaacgtccagcccgcagtggaaacaggtttttttcatggcatttcggtttcgtctgtgtttggtgcggcggcacaatactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcggaaaaggcggaaatcagtttgtgcggcagatcgctgacgaatccgacggtatcggtcaggataatgctgcattcgggactgatgtacagccgccgcgccgtcgtgtcgagtgtggcgaaaagctggtctttcgcatatatgcccgacttggtcagccggttgaacagactggatttgccgacattggtatag

SEQ ID NO: 40399 - protein, 381 aa, Neisseria meningitidis
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDCLTTGAAGFAVFVFVTDGQMQVFGNVQPAVETGFFHGISVSSVFGAAAQYSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRSLTNPTVSVRIMLHSGLMYSRRAVVSSVAKSWSFAYMPDLVSRLNRLDLPTLV

SEQ ID NO: 40400 - DNA, 447 bp, Neisseria gonorrhoeae
atgccgccctcccgacgcggcaacggggtgttttatcaaaacggcaaacttgccaatgcggtttccgcttgccgattgccaaaccggcaaacctttcccgtgccggtgccgaacccgatgccgtctgaaccttcagacggcatcgggtgtttatttgtccactcggacgggtgcaggttcgtattgtgtcgattcgtcgccgtaatacagcacgccgagtttgacggggatgcgtccctgcgatttgcggtgggcgttggaatcgcgcaaggaatacgcgcagccgcagtattcctgctggtagaagttttcgcgtttgctgatttcaatcatacgcgcgccgccgccgcctttgcgccagttgaagtcccaataggccacatcatcgtaaggcgcggcggcacggtgtccgcagtcgttgatttgcgccatatttttccagcgtga

SEQ ID NO: 40401 - protein, 148 aa, Neisseria gonorrhoeae
MPPSRRGNGVFYQNGKLANAVSACRLPNRQTFPVPVPNPMPSEPSDGIGCLFVHSDGCRFVLCRFVAVIQHAEFDGDASLRFAVGVGIAQGIRAAAVFLLVEVFAFADFNHTRAAAAFAPVEVPIGHIIVRRGGTVSAVVDLRHIFPA

SEQ ID NO: 40402 - DNA, 339 bp, Neisseria meningitidis
ccgaacccgatgccgtctgaaccttcagacggcatcgggtgtttatttgtccacccggatgggggcaggttcgtattgtgtcgattcgtcgccgtaatacagcacgccgagtttgatggggattctgccctgtgatttgcggtgggcattggaatccctcagggaataggcacaaccgcaatattcctgctggtagaagttttcacgtttgctgatttcaatcatgcgcgcgctgccgccgcctttgcgccagttgaaatcccaatacaccacatcatcgtaaggcgcggcggcgcggtgtccgcagtcgttgatttgcgccatatttttccagcgtga

SEQ ID NO: 40403 - protein, 111 aa, Neisseria meningitidis
PNPMPSEPSDGIGCLFVHPDGGRFVLCRFVAVIQHAEFDGDSALFAVGIGIPQGIGTTAIFLLVEVFTFADFNHARAAAAFAPVEIPIHHIIVRRGGAVSAVVDLRHIFPA

SEQ ID NO: 40404 - DNA, 441 bp, Neisseria meningitidis
atgccgtcctcccgacgcggcaacggggtgttttatcaaaacggcaaacttgccaatgcggtttccgattgcagattgccaaaccggcaaacctttcccgtgccgatgccgaacccgatgccgtctgaaccttcagacggcatcgggtgtttatttgtccacccggatgggtgcaggttcgtattgtgtcgattcgtcgccgtaatacagcacgccgagtttgatggggattctgccctgtgatttgcggtgggcgttggaatccctcagggaataggcacaaccgcaatattcctgctggtagaagttttcacgtttgctgatttcaatcatacgcgcgctgccgccgcctttgcgccagttgaaatcccaatacaccacatcatcgtaaggcgcggcggcgcggcggccgcagtcgttaatctggttcatgtttttcca

SEQ ID NO: 40405 - protein, 145 aa, Neisseria meningitidis
MPSSRRGNGVFYQNGKLANAVSDCRLPNRQTFPVPMPNPMPSEPSDGIGCLFVHPDGCRFVLCRFVAVIQHAEFDGDSALFAVGVGIPQGIGTTAIFLLVEFTFADFNHTRAAAAFAPVEIPIHHIIVRRGGAAAAVVNLVHVFP

SEQ ID NO: 40406 - DNA, 336 bp, Neisseria gonorrhoeae
atgccgaaatggtcgcgcatacggcgttgcagcgtcctttcgctgatgttcagcgcggctgtcagccggttgacttggtgtgcgccgccgtcgaacgcggcattcagggtgcggctgaagtcttcagacggcatagcgtctgcttccgccgtttgccccgccgccggctcgatgccgtctgaaaccgtgtcccacaaatccgacagcagccgcaacacgtccgcctcgcggcgcaatgtttcgcccaaatgcccctttgggacggtttgcaggcaggatgccgccaagccgcgcaggtttgggggcaaatcccatatcctgaccggttcgcggtaa

SEQ ID NO: 40407 - protein, 111 aa, Neisseria gonorrhoeae
MPKWSRIRRCSVLSLMFSAAVSRLTWCAPPSNAAFRVRLKSSDGIASASAVCPAAGSMPSETVSHKSDSSRNTSASRRNVSPKCPFGTVCRQDAAKPRRFGGKSHILTGSR

SEQ ID NO: 40408 - DNA, 335 bp, Neisseria meningitidis
atgccgaaatggtcgcgcatacggcgttgcagcgtcctttcactgatgttcagcgcgtctgtcagccggttgacttggtgtgcgccgtcggcaaacgcggcatttagggtgcggctgaagtcttcagacggcatagcgtctgcttccgccgtttgccccgccgccggcccgatgccgtctgaaaccgtgtcccacaagtccgacagcagccgcaacacgtccgcctcgcgcgcaatgtttcgcccaaatgcccctttgggacggctttcaggcaggatgccgccaagccgcgcaggttcgggggcaaatcccatatcctgaccggttcgcggtaa

SEQ ID NO: 40409 - protein, 121 aa, Neisseria meningitidis
MPKWSRIRRCSVLSLMFSASVSRLTWCAPSANAAFRVRLKSSDGIASASAVCPAAGPMPSETVSHKSDSSRNTSASRAMFRPNAPLGRNVSPKCPFGTAFRQDAAKPRRFGGKSHILTGSR

SEQ ID NO: 40410 - DNA, 336 bp, Neisseria meningitidis
atgccgaaatggtcgcgcatacggcgttgcagcgtcctttcgctgatgttcagcgtgtctgccagccggttgacttgatgtgcgccgccggcaaacgcggcattcaggatgcggctgaagtcttcagacggcatagcgtctgcttccgccgtttgccccgccgccggcccgatgccgtctgaaaccgtgtcccacaagtccgacagcagccgcaacacgtccgcctcgcggcgcaatgtttcgcccaaatgcccctttgggacggctttcaggcaggatgccgccaagccgcgcaggttcgggggcaaatcccatatcctgaccggttcgcggtaa

SEQ ID NO: 40411 - protein, 110 aa, Neisseria meningitidis
MPKWSRIRRCSVLSLMFSVSASRLTCAPPANAAFRMRLKSSDGIASASAVCPAAGPMPSETVSHKSDSSRNTSASRRNVSPKCPFGTAFRQDAAKPRRFGGKSHILTGSR

SEQ ID NO: 40412 - DNA, 1131 bp, Neisseria gonorrhoeae
atggtttgtcggttatttgccgccgtttttggctttcaactcggcaatcagcccgtcgatgcctttggctttgatgatttcgccgaattggttgcggtacacggtaaccaggctcgtgccttcgatggcgacgttgtaggtacggtatttgccgccgctttggtaggtggtaaagtccatattgacgggcttctgaccggggatgccgacttcggcacggacgacgatttccttgccgcccttattgacgatgggattgtctttgacgttgacggtcgcgtttttgaatttcagcatcgtgccggaataggtgcggatcagcagggtttgaaattctttggccaacgcttgtttttgcgcgtcggacgcggtacgccaagggttgccgaccgccaatgcggtcatacgttggaaatcgaaatagggaaccgcataggcttcggcttttgggcgtgcagaagccgcgtcgccgcttttgaggatggtcaaaacctgtgtggcgttttggcggatttgtcccactgcgtcggccggggaggcaaatgccatgccgatgctcaaaataccgatgcccaatgcgctgatgaaggaggattttttcacgatgtctttcctgaaaatggatgtgtatgtttattctgcggctttttccgcattgccgccctcagcgtttttctcggcgaagctggtcatgaatttaccgatcaggttttccagaaccattgcagaactggttacggagatggtgtcgccggcagcaaggttttccgtatcgccgccctgctgcagcccgatgtactgttcgcccaaaagtcccgaagtcaggatttgcgcggaaacgtcactgctgaactgatacttgccgtccaaatcaaggcgcaccctcgcctgataggatttcgggtcaagcccgatagcgccgacgcgcccgaccaatacgcctgcggatttgacgggggcattgaccttcaaaccgccgatgtcgccgaaatcggcataaacggcgtaagttttgtccgaaccgccgaacgccgcgccgcccgccacgcggaaagcgagaaaggcaaccgccgccgcgccgatcaagacgaacagtccgacccaaaattccaatatgttctttttcattaa

SEQ ID NO: 40413 - protein, 376 aa, Neisseria gonorrhoeae
MVCRLFAAVFGFQLGNQPVDAFGFDDFAELVAVHGNQARAFDGDVVGTVFAAALVGGKVHIDGLLTGDADFGTDDDFLAALIDDGIVFDVDGRVFEFQHRAGIGADQQGLKFFGQRLFLRVGRGTPRVADRQCGHTLEIEIGNRIGFGFWACRSRVAAFEDGQNLCGVLADLSHCVGRGGKCHADAQNTDAQCADEGGFFHDVFPENGCVCLFCGFFRIAALSVFLGEAGHEFTDQVFQNHCRTGYGDGVAGSKVFRIAALLQPDVLFAQKSRSQDLRGNVTAELILAVQIKAHPRLIGFRVKPDSADAPDQYACGFDGGIDLQTADVAEIGINGVSFVRTAERRAARHAESEKGNRRRADQDEQSDPKFQYVLFH

SEQ ID NO: 40414 - DNA, 1137 bp, Neisseria meningitidis
atggtttgtcggttatttgccgccgtttttggctttcaactcggcaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccgggtacgccgacttcggcgcggacgatgatttctttgccgcctttattgacgatgggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttcttcttcattaa

SEQ ID NO: 40415 - protein, 378 aa, Neisseria meningitidis
  misc_feature (96)..(96): Xaa can be any naturally occurring amino acid
  misc_feature (160)..(160): Xaa can be any naturally occurring amino acid
  misc_feature (203)..(203): Xaa can be any naturally occurring amino acid
  misc_feature (206)..(206): Xaa can be any naturally occurring amino acid
MVCRLFAAVFGFQLGNQSVHAFRFDNFAELVAVHGNQARAFDGDVVGTVFTAALVGGEVHVDGFLPGYADFGADDDFFAAFIDDGIVFDVDVGVFXFQHRAGIGADQQGLKFFGQRLFLRVGRGAPRVADRQCGHTLEIEIGNRIGFGFLASGVGIAVFXDAQYLSGVLTDLAYRVGRGGKCHADAQNTDAQCADEGGFFHDXVSXFEYDGIRLFGGFFRIAAVGIFLGKTRHEFADKVFQNHCRTGYGDGVAGSKVFRVAALLQPDVLLAQKSRSQDLRGNVAAELILAVQIEAHPRLIGFRVKSDSADAPDQYACGFDGGIDLQTADVAEIGINGVSFVRTAERRTAGHAESEKGNRRRANQDEQSDPKFQYVLLH

SEQ ID NO: 40416 - DNA, 1137 bp, Neisseria meningitidis
  misc_feature (29)..(29): n is a, c, g, or t
  misc_feature (44)..(44): n is a, c, g, or t
  misc_feature (201)..(202): n is a, c, g, or t
  misc_feature (253)..(253): n is a, c, g, or t
atggcttatggattacttgctgccgtttntagccttcaactcgncaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccggnnacgccgacttcggcgcggacgatgatttctttgccgcctttattgacgatnggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgggcggtgttggcatcaccgctttttaagatgctcaatacttgagtggcgttttgacggatttggtttaccgcgtcggcaggggcggcaaatgccatgccgatgctcaaaataccgatgcccaatgcgctgatgaaggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttctttttcattaa

SEQ ID NO: 40417 - protein, 374 aa, Neisseria meningitidis
  misc_feature (10)..(10): Xaa can be any naturally occurring amino acid
  misc_feature (15)..(15): Xaa can be any naturally occurring amino acid
  misc_feature (68)..(68): Xaa can be any naturally occurring amino acid
  misc_feature (85)..(85): Xaa can be any naturally occurring amino acid
MAYGLLAAVXSLQLXNQSVHAFRFDNFAELVAVHGNQARAFDGDVVGTVFTAALVGGEVHVDGFLPGXADFGADDDFFAAFIDDXIVFDVDVGVFFQHRAGIGADQQGLKFFGQRLFLRVGRGAPRVADRQCGHTLEIEIGNRIGFGFLAGGVGITAFDAQYLSGVLTDLVYRVGRGGKCHADAQNTDAQCADEGGFFHDVSFEYDGIRLFGGFFRIAAVGIFLGKTRHEFADKVFQNHCRTGYGDGVAGSKVFRVAALLQPDVLLAQKSRSQDLRGNVAAELILAVQIEAHPRLIGFRVKSDSADAPDQYACGFDGGIDLQTADVAEIGINGVSFVRTAERRTAGHAESEKGNRRRANQDEQSDPKFQYVLFH

SEQ ID NO: 40418 - DNA, 489 bp, Neisseria gonorrhoeae
atgaaaaaaatactcaccgccgccgccgtcgcactgatcggcatcctcctcgccaccgtcctcatccccgacagtaaaaccgcgcccgccttctccctgcccgacctgcacggaaaaaccgtttccaacgccgacctgcaaggcaaagtcaccctgattaatttttggtttccctcctgtccgggttgtgtgagcgaaatgcccaaagtcaccaaaacggcaaacgactacaaaaataaagatttccaagtcctcgccgttgcccagcccatcgatccgatagaaagcgtccgccaatacgtcaaagactacggactgccgtttaccgtcatttatgatgcggacaaagccgtcggacaggcattcggcacacaggtttatccgacttccgtccttatcggcaaaaaaggcgaaatcctcaaaacttatgtcggcgaacccgatttcggcaaactctaccaagaaatcgataccgcgctggcgcaatag

SEQ ID NO: 40419 - protein, 162 aa, Neisseria gonorrhoeae
MKKILTAAAVALIGILLATVLIPDSKTAPAFSLPDLHGKTVSNADLQGKVTLINFWFPSCPGCVSEMPKVTKTANDYKNKDFQVLAVAQPIDPIESVRQYVKDYGLPFTVIYDADKAVGQAFGTQVYPTSVLIGKKGEILKTYVGEPDFGKLYQEIDTALAQ

SEQ ID NO: 40420 - DNA, 489 bp, Neisseria meningitidis
atgawaaaaatactcaccgccgccgtcgtcgcactgatcggcatcctccttgccatcgtcctcmtccccgacagcaaaaccgcgcccgccttctccmtgcccgacctgcacggaaaaaccgtttccaacgccgacctgcaaggcaaagtaaccctgattaatttttggtttccctcctgtccgggttgtgtgagcgawatgcccaaaatcattaaaacggcaaatgactataaaawcaaaaacttccaagtacttgccgtcgcccagcccatcgatccgatagaaagcgtccgccaatatgtcaaagactacggtttgccgtttaccgtcatgtatgatgcggacaaagctgtcggacaggcgttcggcacacaggtttatccgacttccgtccttatcggcaaataaggcgaaatcttcaaaacctacgtcggcgaacccgatttcggcaaactctaccaagaaatcgatacgcgcgtggcgcaatag

SEQ ID NO: 40421 - protein, 161 aa, Neisseria meningitidis
  misc_feature (2)..(2): Xaa can be any naturally occurring amino acid
  misc_feature (22)..(22): Xaa can be any naturally occurring amino acid
  misc_feature (33)..(33): Xaa can be any naturally occurring amino acid
  misc_feature (66)..(66): Xaa can be any naturally occurring amino acid
  misc_feature (79)..(79): Xaa can be any naturally occurring amino acid
MXKILTAAVVALIGILLAIVLXPDSKTAPAFSXPDLHGKTVSNADLQGKVTLINFWFPSCPGCVSXMPKIIKTANDYKXKNFQVLAVAQPIDPIESVRQYVKDYGLPFTVMYDADKAVGQAFGTQVYPTSVLIGKGEIFKTYVGEPDFGKLYQEIDTRVAQ

SEQ ID NO: 40422 - DNA, 489 bp, Neisseria meningitidis
  misc_feature (105)..(105): n is a, c, g, or t
  misc_feature (119)..(119): n is a, c, g, or t
  misc_feature (125)..(125): n is a, c, g, or t
  misc_feature (145)..(145): n is a, c, g, or t
  misc_feature (152)..(152): n is a, c, g, or t
  misc_feature (162)..(162): n is a, c, g, or t
  misc_feature (202)..(202): n is a, c, g, or t
  misc_feature (206)..(206): n is a, c, g, or t
atgaaaaaaatactcaccgccgccgtcgtcgcactgatcggcatcctccttgccatcgtcctcatccccgacagcaaaaccgcgcccgctttctccctgtccganctgcacggaaaaancgtttncaacgccgacctgcaaggcnaagttancctgattaanttttggtttccctcctgtccgggttgtgtgagcgaaatgnccanaatcattaaaacggcaaatgactataaaaacaaaaacttccaagtccttgccgtcgcccagcccatcgatccgatagaaagcgtccgccaatatgtcaaagactacggtttgccgtttaccgtcatgtatgatgcggacaaagctgtcggacaggcgttcggcacacaggtttatccgacttccgtccttatcggcaaaaaaggcgaaatcctcaaaacttatgtcggcgaacccgatttcggcaaactctaccaagaaatcgataccgcgctggcacaatag

SEQ ID NO: 40423 - protein, 162 aa, Neisseria meningitidis
  misc_feature (35)..(35): Xaa can be any naturally occurring amino acid
  misc_feature (40)..(40): Xaa can be any naturally occurring amino acid
  misc_feature (42)..(42): Xaa can be any naturally occurring amino acid
  misc_feature (49)..(49): Xaa can be any naturally occurring amino acid
  misc_feature (51)..(51): Xaa can be any naturally occurring amino acid
  misc_feature (54)..(54): Xaa can be any naturally occurring amino acid
  misc_feature (68)..(69): Xaa can be any naturally occurring amino acid
MKKILTAAVVALIGILLAIVLIPDSKTAPAFSLSXLHGKXVXNADLQGXVXLIXFWFPSCPGCVSEMXXIIKTANDYKNKNFQVLAVAQPIDPIESVRQYVKDYGLPFTVMYDADKAVGQAFGTQVYPTSVLIGKKGEILKTYVGEPDFGKLYQEIDTALAQ

SEQ ID NO: 40424 - DNA, 426 bp, Neisseria gonorrhoeae
atgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatatttacaagatgcggcttcgagattccgaaccgctcctttaaagagcttgggcttttgatacagataagtctgtcggaacgttttaggactaatgccgaagtcgagatggatgcccattacttccccttactcagaaaatatttaaaatttataatgttacatatagttacaaatattagagttttttgtgtgtgcgtcaaggaattgttgacaattttagttaaaaatttgtctccaaacggaaaaaagcggtttgttttttgttgttaa

SEQ ID NO: 40425 - protein, 141 aa, Neisseria gonorrhoeae
MFVDNGFNKTVASFAQIVETFDVFFFRNDCAFFTQMKQRCGWVCSLVYLVDIFTRCGFEIPNRSFKELGLLIQISLSERFRTNAEVEMDAHYFPLLRKYLKFIMLHIVTNIRVFCVCVKELLTILVKNLSPNGKKRFVFCC

SEQ ID NO: 40426 - DNA, 429 bp, Neisseria meningitidis
atgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatctttccaagatgcggattcgagattccgaaccgctcctttaaagagcttgggcttttgatacagataagtctgtcggaacgttttaggactaatgccgaagtcgagatggatgctcattacttccccttactcagaaaatatttaaaatttataatgttacatatatttacaaatattaaagttttttwttgtgtgtgcgtcaaggaattgttgacaattttagttaaaaatttgtctccaaacggaaaaaagcggtttgttttttgttgttaa

SEQ ID NO: 40427 - protein, 142 aa, Neisseria meningitidis
  misc_feature (115)..(115): Xaa can be any naturally occurring amino acid
MFVDNGFNKTVASFAQIVETFDVFFFRNDCAFFTQMKQRCGWVCSLVYLVDIFPRCGFEIPNRSFKELGLLIQISLSERFRTNAEVEMDAHYFPLLRKYLKFIMLHIFTNIKVFXCVCVKELLTILVKNLSPNGKKRFVFCC

SEQ ID NO: 40428 - DNA, 380 bp, Neisseria meningitidis
atgttcgtagataacggatttaataaaacggtagcgagttttgcccaaatcgtcgaaactttcgacgtattcttctttaggaacaattgcaccttttttacgcagatgaaacagcggtgcggttgggtctgctcgttggtatatctcgttgatatctttccaagatgcggcttcgagattccgaaccgctcctttaaagagcttgggcttttgatacagataagtctgtcggaacgttttaggactaatgccgaagtcgagatagatgctcattacttccccttactcagaaaatatttaaaatttataatgttacatatatttacaaatattaaagttttttttgtgtgtgcgtcaaggaattgttgacaattttagtt

SEQ ID NO: 40429 - protein, 127 aa, Neisseria meningitidis
  misc_feature (115)..(115): Xaa can be any naturally occurring amino acid
MFVDNGFNKTVASFAQIVETFDVFFFRNNCTFFTQMKQRCGWVCSLVYLVDIFPRCGFEIPNRSFKELGLLIQISLSERFRTNAEVEIDAHYFPLLRKYLKFIMLHIFTNIKVFXCVCVKELLTILV

SEQ ID NO: 40430 - DNA, 654 bp, Neisseria gonorrhoeae
atgttttccgtaccgcgttcctttttgccgggcgttttcgtacttgccgcgcttgccgcctgcaaacctcaagacaacagtgcggcgcaagccgcttcttcaagtgcatccgcgccggctgcggaaaatgcggcaaagccgcaaacgcgcggtacggatatgcgtaaggaagacatcggcggcgatttcacactgaccgacggcgaaggcaagcctttcagcctgagcgatttgaaaggcaaggtcgtgattctgtctttcggctttacgcactgtcccgatgtctgcccgacagggcttttgacgtacagcgacactttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaaatcaatcaaaaagacgacagcgaaaactatttggtcgaccactcttccggtgcgtatcttatcgataaaaacggtgaggttgccattttctcgccttacggaagcgagccggaaacgattgctgccgatgtaaggaccctgctctga

SEQ ID NO: 40431 - protein, 217 aa, Neisseria gonorrhoeae
MFSVPRSFLPGVFVLAALAACKPQDNSAAQAASSSASAPAAENAAKPQTRGTDMRKEDIGGDFTLTDGEGKPFSLSDLKGKVVILSFGFTHCPDVCPTGLLTYSDTLKQLGGQAKDVKVVFVSIDPERDTPEIIGKYAKQFNPDFIGLTATGGQNLPVIKQQYRVVSAKINQKDDSENYLVDHSSGAYLIDKNGEVAIFSPYGSEPETIAADVRTLL

SEQ ID NO: 40432 - DNA, 654 bp, Neisseria meningitidis
  misc_feature (142)..(142): n is a, c, g, or t
atgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagcaanacacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcgstctgacggcaacgggcggccaaaacctgccggtcatcaagcagcaataccgcgtggtttctgccaaagtcaatcaaaamgacgacagcgaaaactatttggtcgaccactcttccggtgcgtatctcatcgacaaaaacggtgaggttgccattttctcgccttacggaagcgagccggaaacgattgctgccgatgtaaggaccctgctctga

SEQ ID NO: 40433 - protein, 217 aa, Neisseria meningitidis
  misc_feature (48)..(48): Xaa can be any naturally occurring amino acid
  misc_feature (147)..(147): Xaa can be any naturally occurring amino acid
  misc_feature (173)..(173): Xaa can be any naturally occurring amino acid
MFSVPRSFLPGVFVLAALAACKPQDNSAAQVASSSASASAAENAAKQXTRGTDMRKEDIGGDFTLTDGEGKPFNLSDLKGKVVILSFGFTHCPDVCPTELLTYSDTLKQLGGQAKDVKVVFVSIDPERDTPEIIGKYAKQFNPDFIXLTATGGQNLPVIKQQYRVVSAKVNQXDDSENYLVDHSSGAYLIDKNGEVAIFSPYGSEPETIAADVRTLL

SEQ ID NO: 40434 - DNA, 654 bp, Neisseria meningitidis
atgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagccgcaaacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcgaccaaaacctgccggtcatcaagcagcaataccgcgtggtttctgccaaagtcaatcaaaaagacgacagcgaaaactatttggtcgaccactcttccggtgcgtatctcatcgacaaaaacggtgaggttgccattttctcgccttacggaagcgagccggaaacgattgctgccgatgtaaggaccctgctctga

SEQ ID NO: 40435 - protein, 217 aa, Neisseria meningitidis
MFSVPRSFLPGVFVLAALAACKPQDNSAAQVASSSASASAAENAAKPQTRGTDMRKEDIGGDFTLTDGEGKPFNLSDLKGKVVILSFGFTHCPDVCPTELLTYSDTLKQLGGQAKDVKVVFVSIDPERDTPEIIGKYAKQFNPDFIGLTATGDQNLPVIKQQYRVVSAKVNQKDDSENYLVDHSSGAYLIDKNGEVAIFSPYGSEPETIAADVRTLL

SEQ ID NO: 40436 - DNA, 945 bp, Neisseria gonorrhoeae
atgataacggacaggtttcatctctttcattttccagtatctttcatttatcaatctgacaacaaaatgccgcctgaaaacagttcagacggcattttaaccacaaacggcttacagcttccattcgcccaacttggcagcgtaagcttccaaatctgcaatcggacgggttgccacgccgctttccatcgctgctttggcggcagccgtagcgacgcgaggcagcaggcgggaatcgaacggagtaggaatcaggtattccgcgccgaattcgaatttcttaccgtaagcggcaaccacttcttcggttacttcttccatcgccaaatctgccaaagcatacacgcaggcgcgtttcatttcttcgttgatggtggttgcgccgacatccaacgcgccccggaagatgaacgggaagcacaatacgttgttcacttggttcgggaagtcggagcggccggtaccgataaccacgtccggacgggtttctttcgccagcggcggcaggatttccggattcgggttggccatggcgaacacgatgggtttttcgttcatcgtgttcaacatttcaggcgtcagcaggtttgcgccggagaggcccaagaagatgtctttgcctttaaccgcatcggcaagtacgcgccggccgttgtcttcaacggcgtagaattttttggattcgtccatgcggtctttgtcttcgcgggtttggtaaatcacgcctttggagttgcaaacggttacgttttcacgtttcaagcccaaatccagcagttggttcaggcaggcaatcgcggcggcacctgcgccggagcacaccaaagtcgcttcttcgattttacggccggtataacgcagggcgttcaatacggcggcggcggtaatgatggccgtgccgtgctggtcatcatgaaatacggggattttgcagcgtttgcgtaa

SEQ ID NO: 40437 - protein, 314 aa, Neisseria gonorrhoeae
MITDRFHLFHFPVSFIYQSDNKMPPENSSDGILTTNGLQLPFAQLGSVSFQICNRTGCHAAFHRCFGGSRSDARQQAGIERSRNQVFRAEFEFLTVSGNHFFGYFFHRQICQSIHAGAFHFFVDGGCADIQRAPEDEREAQYVVHLVREVGAAGTDNHVRTGFFRQRRQDFRIRVGHGEHDGFFVHRVQHFRRQQVCAGEAQEDVFAFNRIGKYAPAVVFNGVEFFGFVHAVFVFAGLVNHAFGVANGYVFTFQAQIQQLVQAGNRGGTCAGAHQSRFFDFTAGITQGVQYGGGGNDGRAVLVIMKYGDFAAFA

SEQ ID NO: 40438 - DNA, 321 bp, Neisseria meningitidis
gacggcatcggcaagcacgcgctggccgttgtcttcaatggcgtagaactgtttggactcgtccatacggtctttgtcttcgcgggtttggtaaatcacgcctttggagtcgcaaacggtcacgttttcgcgtttcaagcccaaatccagcaattggwtcaagcaggcaatcgcggccgcacctgcgccggaacacaccaaagtcgcttcttcgattttacggccggtaaaacgcakggcgttcaatacggcggcggcggtaatgatggccgtgccgtgctggtcgtcgtggaatacggggattttgcagcgtttgcgtaa

SEQ ID NO: 40439 - protein, 106 aa, Neisseria meningitidis
  misc_feature (53)..(53): Xaa can be any naturally occurring amino acid
  misc_feature (79)..(79): Xaa can be any naturally occurring amino acid
DGIGKHALAVVFNGVELFGLVHTVFVFAGLVNHAFGVANGHVFAFQAQIQQLXQAGNRGRTCAGTHQSRFFDFTAGKTXGVQYGGGGNDGRAVLVVVEYGDFAAFA

SEQ ID NO: 40440 - DNA, 900 bp, Neisseria meningitidis
ctatatcaatctgacagcaaaatgccgcctgaaaacagttcagacggcattttaaccgcaaacggcttacagcttccattcgctcagcttggcagcgtaagcttccaaatctgcaatcggacgggttgccacgccgctttccatcgctgctttggcggcagccgtagcaacgcgcggcagcaggcgggaatcgaacggagtcggaatcaggtattccgcgccgaattcaaatttcttaccgtaagcggcaaccacttcttcggttacctcttccatcgccaaatccgccaaagcatacacgcaggcgcgtttcatttcttcgttgatggtcgtcgcgccgacatccaacgcaccgcggaagatgaacgggaagcacaatacattgttcacttggttcgggaagtcggagcggccggtaccgataaccacgtccggacgggtttctttcgccagcggcggcaggatttccggattcgggttggccatagcgaacacgatgggtttttcgttcatggtgttcagtatttcaggcgtcagcaggttcgcgccggagaggcccaagaagatgtctttgcctttgacggcatcggcaagcacgcgctggccgttgtcttcaatggcgtagaactgtttggactcgtccatacggtctttgtcttcgcgggtttggtaaatcacgcctttggagtcgcaaacggtcacgttttcgcgtttcaagcccaaatccagcaattggttcaagcaggcaatcgcggccgcacctgcgccggaacacaccaaagtcgcttcttcgattttacggccggtaaaacgcagggcgttcaatacggcagcggcggtaatgatggccgtgccgtgctggtcgtcgtggaatacggggattttgcagcgtttgcgtaa

SEQ ID NO: 40441 - protein, 299 aa, Neisseria meningitidis
LYQSDSKMPPENSSDGILTANGLQLPFAQLGSVSFQICNRTGCHAAFHRCFGGSRSNARQQAGIERSRNQVFRAEFKFLTVSGNHFFGYLFHRQIRQSIHAGAFHFFVDGRRADIQRTAEDEREAQYIVHLVREVGAAGTDNHVRTGFFRQRRQDFRIRVGHSEHDGFFVHGVQYFRRQQVRAGEAQEDVFAFDGIGKHALAVVFNGVELFGLVHTVFVFAGLVNHAFGVANGHVFAFQAQIQQLVQAGNRGRTCAGTHQSRFFDFTAGKTQGVQYGSGGNDGRAVLVVVEYGDFAAFA

SEQ ID NO: 40442 - DNA, 534 bp, Neisseria gonorrhoeae
atgaagctgaaaaccttgttattgcccttcgccgcactggcattgtgtgccaacgcatttgccgccccgcccggcgacgcgtcgttggcacgttggctggatacgcagaatttcgaccgggatatagaaaaaaatatgattgaaggctttaatgccggatttaaaccgtatgcggacaaagcccttgccgaaatgccggaagcgaaaaaagatcaggcggcagaagcctttaatcgttatcgtgagaatgttttgaaagatttgattacgcccgaagtgaaacaggctgtccgcaataccttattgaagaatgcccgtgaaatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcgacatcatctgcccgagtttacggaagagttacggcgcatcatctgcggcggtatagtggattaa

SEQ ID NO: 40443 - protein, 177 aa, Neisseria gonorrhoeae
MKLKTLLLPFAALALCANAFAAPPGDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIARHHLPEFTEELRRIICGGIVD

SEQ ID NO: 40444 - DNA, 582 bp, Neisseria meningitidis
attaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataa

SEQ ID NO: 40445 - protein, 193 aa, Neisseria meningitidis
IKLKTLLLPFATLALCTNAFAAPPSDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIAQHHLPEFTEELRRIICGGKNPDAGCKQAGQVGKRHQK

SEQ ID NO: 40446 - DNA, 582 bp, Neisseria meningitidis; identical to SEQ ID NO: 40444

SEQ ID NO: 40447 - protein, 193 aa, Neisseria meningitidis; identical to SEQ ID NO: 40445

SEQ ID NO: 40448 - DNA, 588 bp, Neisseria meningitidis
ttgaatattaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataa

SEQ ID NO: 40449 - protein, 195 aa, Neisseria meningitidis
LNIKLKTLLLPFATLALCTNAFAAPPSDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIAQHHLPEFTEELRRIICGGKNPDAGCKQAGQVGKRHQK

SEQ ID NO: 40450 - DNA, 588 bp, Neisseria meningitidis; identical to SEQ ID NO: 40448

SEQ ID NO: 40451 - protein, 195 aa, Neisseria meningitidis; identical to SEQ ID NO: 40449

SEQ ID NO: 40452 - DNA, 792 bp, Neisseria gonorrhoeae
atggattatctgcaaaacctgtctttgggcttgacaaaaaagctgcccgttatactgcaaacagaagtagcggagtgtggcttggcatgtctagcggctgtggccggattttatggtttctatacggatttgcgcgcactgcgttcaaaatactgtctgtcacttaagggtgagaatttggcagatattgttcgttttgctgatgatatggggctgacgggacgggcgttgaggctggatttagacgaattgggcagtttgcgcctgccctgtattctacattgggatttgaatcattttgtggtgctggaatcggtatcttcggacggggctgccgtcatggatccggcttcgggacgacgcaaagtcaagacggaggaaatatcgcgcaagtttacgggaattgctttggaactgtggccaaacacgcgtttcgaggcaggggaagaaaagcaggaaatccgcatcctacccatgttgcgcgggatttctgggctggggcggacattgtttcagcttttggctttggcagcagcaatggaagtgtttgcttttttacaaaacgtcagcttcaagatcggacgtggtgaatcgcttgcgttaatcggacgatcgggctgcggtaaatcgacacttttggatattttaagcggcaatctacctcccgaatcaggcaaagtcatgataaatgggcacgacatttacagcttaccgccaccttttattccgcaatttgagtgcgatggtcaaggcaggacgatgttttatagtggattaaatttaaaccggtag

SEQ ID NO: 40453 - protein, 263 aa, Neisseria gonorrhoeae
MDYLQNLSLGLTKKLPVILQTEVAECGLACLAAVAGFYGFYTDLRALRSKYCLSLKGENLADIVRFADDMGLTGRALRLDLDELGSLRLPCILHWDLNHFVVLESVSSDGAAVMDPASGRRKVKTEEISRKFTGIALELWPNTRFEAGEEKQEIRILPMLRGISGLGRTLFQLLALAAAMEVFAFLQNVSFKIGRGESLALIGRSGCGKSTLLDILSGNLPPESGKVMINGHDIYSLPPPFIPQFECDGQGRTMFYSGLNLNR

SEQ ID NO: 40454 - DNA, 554 bp, Neisseria meningitidis
atggattatttatcaagactgtcctttggatttaacaaaaagctacctgtcattctgcaaacagaagttgctgaatgtggtttagcatgcctgacatccatcttgtcctattatggctttcacactgatttaagaacgttacgccaaaaatacaccctgtcattaaagggcgcaaatcttgcagacatcatgagatttggcaatgaaatgaatttaacgccacgagctttgcgtttagagttagatgagctgtcaaatttacaactaccctgcattctccattggaacttaaaccattttgttgtactttgttccatttccaaagacagtatcgtcattatggaccctgctgtcggtatgcgaaaaatcaaaatggacgaagtttcacaaaaattcacagggattgccctagaattattccccaatacccattttgaagagaaaaaagaaacaaagaaaatcaaaatattatctctattaagggggggtcaggcttaaaacgctctttaattcaaatgcttatattagctatttctttggaagtctttgcattg

SEQ ID NO: 40455 - protein, 185 aa, Neisseria meningitidis
  misc_feature (163)..(163): Xaa can be any naturally occurring amino acid
MDYLSRLSFGFNKKLPVILQTEVAECGLACLTSILSYYGFHTDLRTLRQKYTLSLKGANLADIMRFGNEMNLTPRALRLELDELSNLQLPCILHWNLNHFVVLCSISKDSIVIMDPAVGMRKIKMDEVSQKFTGIALELFPNTHFEEKKETKKIKILSLLRGXSGLKRSLIQMLILAISLEVFAL

SEQ ID NO: 40456 - DNA, 153 bp, Neisseria meningitidis
atgccccatctgcaaaacctgtctttgggcttaaagaaaaagctgcctgttatcctgcaaacagaaatatcagaatgcggcttggcatgtctggcggctgtggcgggatttcatggtttccatacgaatttacgcgcactgcgttcaaaatac

SEQ ID NO: 40457 - protein, 51 aa, Neisseria meningitidis
MPHLQNLSLGLKKKLPVILQTEISECGLACLAAVAGFHGFHTNLRALRSKY

SEQ ID NO: 40458 - DNA, 1170 bp, Neisseria meningitidis
atgacagcacataaaatcctgcccgtccttcttcccatcatcttaggcgtttctcacgcaacggctgcatcgcccgcgcccaacagaccgacggtacacgccgcccccacgctccaaacacccgaaaccctcacggcggcacacatcgttatcgaccttcaaagcaggcagactttatccgccaaaaacaccaatacccctgtcgaaccggcggcactaacccaactgatgaccgcatatttggttttcaaaaacatgaaatcgggaaatatccaatctgaagaaaacttaaaaatacccgaatccgcatgggcttcagaaggaagcagaatgtttgtacgtcccggcgatacggtcagcaccgacaaactcttaaaaggcatgattgccctatgcgcaaacgatgccgccctaacccttgccgaccggctgggcaacggctcgattgaaaattttgtgcaacaaatgaacaaagaagcccgacgcttgggcatgaagaacaccgtattcaaaaacccgacaggcttgggtagagaaggacaggtttccaccgccaaagacctctccctgctgtctgaagcattgatgcgcgactttccggaatattacccgctgttttccatcaaatcgttcaagtttgaaaacatagaacaaaacaaccgcaatatccttttatatagggacaacaatgtaaacggcctgaaagccgggcacacagaaagcggcggctacaaccttgccgtgtcatactccggcaacggcaggcacatccttgtcatcacactaggttcggaatcggcggaaacccgcgcatcggacaacagcaagctgctgaaccgggcattgcaggccttcgatacgcccaaaatatatccgaaaggcaaaaccgttgcccaaatccaaatttccggaggcagcaaaaaaaccgtccgcgcaggcttcctcaaagaagcctacatcactctgccacataaagaagcgaaaatggcagaacagattttggaaaccatacagccgattcccgccccggtaaaaaaagggcagattttaggaaaaatcaaaatcaggcaaaacggacataccattgccgaaaaagaaatcgtcgcactggaaaacgtagaaaaaagaagccggtggcaaaggctttggacgcgtctgacagggcagtaa

SEQ ID NO: 40459 - protein, 389 aa, Neisseria gonorrhoeae
MTAHKILPVLLPIILGVSHATAASPAPNRPTVHAAPTLQTPETLTAAHIVIDLQSRQTLSAKNTNTPVEPAALTQLMTAYLVFKNMKSGNIQSEENLKIPESAWASEGSRMFVRPGDTVSTDKLLKGMIALCANDAALTLADRLGNGSIENFVQQMNKEARRLGMKNTVFKNPTGLGREGQVSTAKDLSLLSEALMRDFPEYYPLFSIKSFKFENIEQNNRNILLYRDNNVNGLKAGHTESGGYNLAVSYSGNGRHILVITLGSESAETRASDNSKLLNRALQAFDTPKIYPKGKTVAQIQISGGSKKTVRAGFLKEAYITLPHKEAKMAEQILETIQPIPAPVKKGQILGKIKIRQNGHTIAEKEIVALENVEKRSRWQRLWTRLTGQ

SEQ ID NO: 40460 - DNA, 1170 bp, Neisseria meningitidis
atgacagcacataaaatcctgcccgtcctgctttccatcatcttaggcgtttctcacgcaacggctgcatcgcccgcgcccaacagaccgacggtacacgccgcccccacgttccaaacacccgaaaccctcacagcggcacacatcgttatcgaccttcaaagcaaacagattttatccgccaaaaacatcaatacccctgttgaaccggcggcactaacccaactgatgaccgcatatctggttttcaaaaacatgaaatcgggcaatatccaatctgaagaaaacttaaaaatacccgaatccgcatgggcttcagaaggaagcagaatgtttgtacgtcccggcgatacggtcagcaccgacaaactcttaaaaggcatgattgcactatccgcaaacgatgccgccctaacccttgccggccggctgggcaacggctcgattgaaaattttgtgcaacaaatgaacaaagaagcccgacgcttgggcatgaagaacactgtattcaaaaacccgacaggcttgagtagagaaggacaggtttccaccgccaaagacctcgccctgctgtctgaagcattgatgcgcgactttccggaatattacccgctgttttccatcaaatctttcaaattcaaaaatatagaacaaaacaaccgcaatatccttttatatagggacaacaatgtaaacggtctgaaagccggacacacagaaagcggcggctacaaccttgccgtgtcatactccggcaacggcaggcacatccttgtcatcacattgggttcggaatcggcggaaacacgcgcatcagacaacagcaagctgctgaactgggcattgcaggccttcgatacgcccaaaatatatccgaaaggcaaaaccgttgcccaaatccaaatttccggaggcagcaaaaaaaccgtccgcgcaggcttcctcaaagaagcctacatcactctgccacataaggaagcgaaaatggcagaacaaattctagaaaccatacagccgattcccgccccagtaaaaaaagggcaaattttaggaaaaatcaaaatcagacaaaacggatacaccattgccgaaaaagaaatcgtcgcactggaaaatgtaaaaaaaagaagccggtggcaaaggctttgggcgtgtctgacagggcagtaa

SEQ ID NO: 40461 - protein, 389 aa, Neisseria meningitidis
MTAHKILPVLLSIILGVSHATAASPAPNRPTVHAAPTFQTPETLTAAHIVIDLQSKQILSAKNINTPVEPAALTQLMTAYLVFKNMKSGNIQSEENLKIPESAWASEGSRMFVRPGDTVSTDKLLKGMIALSANDAALTLAGRLGNGSIENFVQQMNKEARRLGMKNTVFKNPTGLSREGQVSTAKDLALLSEALMRDFPEYYPLFSIKSFKFKNIEQNNRNILLYRDNNVNGLKAGHTESGGYNLAVSYSGNGRHILVITLGSESAETRASDNSKLLNWALQAFDTPKIYPKGKTVAQIQISGGSKKTVRAGFLKEAYITLPHKEAKMAEQILETIQPIPAPVKKGQILGKIKIRQNGYTIAEKEIVALENVKKRSRWQRLWACLTGQ

SEQ ID NO: 40462 - DNA, 1170 bp, Neisseria meningitidis
atgacagcacataaaatcctgcccgtcctgctttccatcatcttaggcgtttctcacgcaacggctgcatcgcccgcgcccaacagaccgacggcacacgccgcccccacgttccaaacacccgaaaccctcacagcggcacacatcgttatcgaccttcaaagcaaacagattttatccgccaaaaacatcaatacccctgtcgaaccggcggcactaacccaactgatgaccgcatatctggttttcaaaaacatgaaatcgggaaatatccgatctgaagaaaacttaaaaatacccgaatccgcatgggcttcagaaggaagcagaatgtttgtacgtcccggcgatacggtcagcaccgacaaactcttaaaaggcatgattgcactatccgcaaacgatgccgccctaacccttgccggccggctgggcaacggctcgattgaaaattttgtgcaacaaatgaacaaagaagcccgacgcttgggcatgaagaacactgtattcaaaaatccgacaggcttgagtagagaaggacaggtttccaccgccaaagacctcgcccagctgtctgaagcattgatgcgcgactttccggaatattacccgctgttttccatcaaatctttcaaattcaaaaatatagagcaaaacaaccgcaatatccttttatatagggacaacaatgtaaacggtctgaaagccggacacacagaaagcggcggctacaaccttgccgtgtcatactccggcaacggcaggcacatccttgtcatcacattgggttcggaatcggcggaaacacgcgcatcagacaacagcaagctgctgaactgggcattgcaagccttcgatacgcccaaaatatatccgaaaggcaaaaccgttgcccaaatccaaatttccggaggcagcaaaaaaaccgtccgcgcaggcttcctcaaagaagcctacatcactctgccacataaggaagcgaaaatggcagaacaaattctagaaaccatacagccgattcccgccccagtaaaaaaagggcaaattttaggaaaaatcaaaatcagacaaaacggatacaccattgccgaaaaagaaatcgtcgcactggaaaatgtaaaaaaaagaagccggtggcaaaggctttgggcgtgtctgacagggcagtaa

SEQ ID NO: 40463 - protein, 389 aa, Neisseria meningitidis
MTAHKILPVLLSIILGVSHATAASPAPNRPTAHAAPTFQTPETLTAAHIVIDLQSKQILSAKNINTPVEPAALTQLMTAYLVFKNMKSGNIRSEENLKIPESAWASEGSRMFVRPGDTVSTDKLLKGMIALSANDAALTLAGRLGNGSIENFVQQMNKEARRLGMKNTVFKNPTGLSREGQVSTAKDLAQLSEALMRDFPEYYPLFSIKSFKFKNIEQNNRNILLYRDNNVNGLKAGHTESGGYNLAVSYSGNGRHILVITLGSESAETRASDNSKLLNWALQAFDTPKIYPKGKTVAQIQISGGSKKTVRAGFLKEAYITLPHKEAKMAEQILETIQPIPAPVKKGQILGKIKIRQNGYTIAEKEIVALENVKKRSRWQRLWACLTGQ

SEQ ID NO: 40464 - DNA, 420 bp, Neisseria gonorrhoeae
atggacaataagaccaaactgcgcttgggcggcctgattttactgaccaccgccgttttaagcctcattatcgtattgattgtcgattcctggccgcttgccatcctgcttgccgccgtcatcgtcgccgccgctgcgggcggctttgtttggacatcccgccgacagcaacgccagtttatcgaacgtctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaa

SEQ ID NO: 40465 - protein, 139 aa, Neisseria gonorrhoeae
MDNKTKLRLGGLILLTTAVLSLIIVLIVDSWPLAILLAAVIVAAAAGGFVWTSRRQQRQFIERLKKFDIDPEKGRINEANLRRMYHSGGQHQKDAITLICLSQKCSVDEAHAMFKKRPTRQEINQMAAKQSRGQKRPHR

SEQ ID NO: 40466 - DNA, 420 bp, Neisseria meningitidis
atggacaataagaccaaactgcgcttgggcggcctgattttactgaccaccgccgttttaagcctcattatcgtattgattgtcgattcctggccgcttgccatcctgcttgcagccgtcattgtcgctgccgctgcgggcggttttgtttggacatcccgccgacagcaacgccagtttatcgaacgcctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaa

SEQ ID NO: 40467 - protein, 139 aa, Neisseria meningitidis; identical to SEQ ID NO: 40465

SEQ ID NO: 40468 - DNA, 420 bp, Neisseria meningitidis
atggacaataagaccaaactgcgcttgggcggcctgattttactgaccaccgccgttttaagcctcattatcgtattgattgtcgattcctggccgcttgccatcctgcttgccgccgtcatcgtcgccgccgctgcgggcggctttgtttggacatcccgccgacagcaacgccagtttatcgaacgtctgaaaaaattcgacatcgatcccgaaaaaggcagaatcaacgaggcaaacctgcgccgtatgtaccacagcggcggacaacaccaaaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaa

SEQ ID NO: 40469 - protein, 139 aa, Neisseria meningitidis; identical to SEQ ID NO: 40465

SEQ ID NO: 40470 - DNA, 480 bp, Neisseria gonorrhoeae
atgaacaaaatattccttactgccgcagccttggtgctgggcgcgtgcggtttccacctgaaaggtgcagacggcatttctccgccgctgacctaccggagctggcacatcgaaggcggacaggcattgcaatttcctttggaaaccgcgctgtatcaggcttcgggcagggtggacgatgctgccggcgcgcagatgaccctgcgtatagacagcgtttcccaaaacaaggaaacctataccgttacccgtgcggcagtcatcaacgaatatcttttgatattgacggttgaagcgcaggtattgaaacgcggcgagccggtcggcaaaccgatgaccgtgtccgtccgccgcattttggattatgccgacaacgaaattttgggcaaacaggaagaagaagaaaccctgtgggcggaaatgcggcaggatgttgccgaacagattgtccgccgcctgacctttctgaaggcggaatga

SEQ ID NO: 40471 - protein, 159 aa, Neisseria gonorrhoeae
MNKIFLTAAALVLGACGFHLKGADGISPPLTYRSWHIEGGQALQFPLETALYQASGRVDDAAGAQMTLRIDSVSQNKETYTVTRAAVINEYLLILTVEAQVLKRGEPVGKPMTVSVRRILDYADNEILGKQEEEETLWAEMRQDVAEQIVRRLTFLKAE

SEQ ID NO: 40472 - DNA, 480 bp, Neisseria meningitidis
atgaacaaactgtttcttactgccgcagtgctgatgctgggcgcgtgcggtttccacctgaaaggtgcagacggcatttctccgccgctgacctaccggagctggcacatcgaaggcggacaggcattgcggtttcctttggaaaccgcgctgtatcaggcttcgggcagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggtaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatga

SEQ ID NO: 40473 - protein, 159 aa, Neisseria meningitidis
MNKLFLTAAVLMLGACGFHLKGADGISPPLTYRSWHIEGGQALRFPLETALYQASGRVDDAAGAQMTLRIDSVSQNKETYTVTRAAVINEYLLILTVEAQVLKRGEPVGKPMTVSVRRVLAYADNEILGKQEEEAALWAEMRQDAAEQIVRRLTFLKAE

SEQ ID NO: 40474 - DNA, 480 bp, Neisseria meningitidis
atgaacaaactgtttcttactgccgcagtgctgatgctgggcgcgtgcggtttccacctgaaaggtgcagacggcatttctccgccgctgacctaccggagctggcacatcgaaggcggacaggcattgcagtttcctttggaaaccgcgctgtatcaggcttcgggtagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggcaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatga

SEQ ID NO: 40475 - protein, 159 aa, Neisseria meningitidis
MNKLFLTAAVLMLGACGFHLKGADGISPPLTYRSWHIEGGQALQFPLETALYQASGRVDDAAGAQMTLRIDSVSQNKETYTVTRAAVINEYLLILTVEAQVLKRGEPVGKPMTVSVRRVLAYADNEILGKQEEEAALWAEMRQDAAEQIVRRLTFLKAE

SEQ ID NO: 40476 - DNA, 321 bp, Neisseria gonorrhoeae
atggatgcttgttttttcgtcattcccgcacaggcgggaattcggagattcgggattgttttcaaacgttcgggtcggattcttgccggtgcgggaatgatgcccttatatactttctccgagctttatatgcttcaacaggggacggcacatcaagcaccgcactgcgtgttgcccgaacgaggctgccctccgattagattctatcgctataaacagacgggtttcaaccgaaaaggaatggggataaagtccatttccgacacctctcgggcgatgccgtctgaaaaccaatctccactttcagacggcattgtttag

SEQ ID NO: 40477 - protein, 106 aa, Neisseria gonorrhoeae
MDACFFVIPAQAGIRRFGIVFKRSGRILAGAGMMPLYTFSELYMLQQGTAHQAPHCVLPERGCPPIRFYRYKQTGFNRKGMGIKSISDTSRAMPSENQSPLSDGIV

SEQ ID NO: 40478 - DNA, 321 bp, Neisseria meningitidis
atgaatgcttgttttttcgtcattcccacacaggcgggaattcggagattcgggattgttttcaaacgttcgggtcggattcttgccggtgcaggaatgatgcccttatatactttctccgagctttatatgtttcaacaggggacggcacatcaagcaccgcactgcgtgttgcccgaacgagactaccctccgattagattctatcgccataaacagacgggtttcaaccgaaaaggaatggggataaagtccatttccgacatctstcgggcgatgccgtctgaaaaccaatctccactttcagacggcattgtttag

SEQ ID NO: 40479 - protein, 106 aa, Neisseria meningitidis
  misc_feature (90)..(90): Xaa can be any naturally occurring amino acid
MNACFFVIPTQAGIRRFGIVFKRSGRILAGAGMMPLYTFSELYMFQQGTAHQAPHCVLPERDYPPIRFYRHKQTGFNRKGMGIKSISDIXRAMPSENQSPLSDGIV

SEQ ID NO: 40480 - DNA, 426 bp, Neisseria meningitidis
atgaatgcttgttttttcgtcattcccacacaggcgggaattcggagattcgggattgttttcaaacgttcgggtcggattcttgccggtgcgggaatgatgcccttatatatagtggattaaatttaaatcaggacaaggcgacgaagccgcagacagtacaaatagtacggcaaggcgaggcaacgccgtactggtttaaatttaatccactatactttctccgagctttatatgtttcaacagaggacggcacatcaagcaccgcactgcgtgttgcccgaacgagactgccctccgattagattctatcgctataaacagacgggtttcaaccgaaaaggaatgggaatgaagtccgtttccgacacctctcgggcgatgccgtctgaaaaccaatctccactttcagacggcattgtttag

SEQ ID NO: 40481 - protein, 138 aa, Neisseria meningitidis
MNACFFVIPTQAGIRRFGIVFKRSGRILAGAGMMPLYIVDIIRTRRRSRRQYKYGKARQRRTGLNLIHYTFSELYMFQQRTAHQAPHCVLPERDCPPIRFYRYKQTGFNRKGMGMKSVSDTSRAMPSENQSPLSDGIV

SEQ ID NO: 40482 - DNA, 744 bp, Neisseria gonorrhoeae
atgctcatcatccgcaacctgatttactggctgatactctgttccagcctgattttcctctttccctttatgctgctcgcctcgcctttccgggacggggcgcacaagatggcgcgggtctgggtcggcatcctcaactggtcgctcaaacacatcgtcgggctcaaataccgcatcatcggcgcggaacacattccggaccgcccctccgtcatctgcgccaaacaccaaagcggctgggaaacgctcgcgctccaagagatttttccgccgcaggtttacgttgccaagcgcgagttgttcaaaatcccctttttcggctggggcttgaaactggtcaaaaccataggcatagaccgcaacaaccgccgcgaagccaacgaacagctcataaaacagggtttggcgcgcaaaaacgaaggttattggattaccattttccccgaaggcacgcgccttgcgcccggaaaacgcggcaaatacaaactcggcggcgcgcgcatggcgaaaatgtttgagatggacatcgtccccgtcgccctcaacagcggcgaattttggccgaaaaattcctttctgaaatatccgggggaaatcaccgtcatcatctgtccgaccatcccgcacgcaagcggcagcgaagccgaattgatggaaaaatgcgaacacctcattgaaacgcaacaaccgcttatttccggcgcaggcccgtttgccgccgaaatgccgtctgaaaccgcatga

SEQ ID NO: 40483 - protein, 246 aa, Neisseria gonorrhoeae
MLIIRNLIYWLILCSSLIFLFPFMLLASPFRDGAHKMARVWVGILNWSLKHIVGLKYRIIGAEHIPDRPSVICAKHQSGWETLALQEIFPPQVYVAKRELFKIPFFGWGLKLVKTIGIDRNNRREANEQLIKQGLARKNEGYWITIFPEGTRLAPGKRGKYKLGGARMAKMFEMDIVPVALNSGEFWPKNSFLKYPGEITVIICPTIPHASGSEAELMEKCEHLIETQQPLISGAGPFAAEMPSET

SEQ ID NO: 40484 - DNA, 744 bp, Neisseria gonorrhoeae
atgctcatcatccgcaacctgatttactggctgatactctgttccaccctgattttcctctttccctttatgctgctcgcctcgcctttccgggacggggcgcacaagatggcgcgggtctgggtcggcattctcaactggtcgctcaaacacatcgtcgggctcaaataccgcatcatcggcgcggaaaacatccccgaccgccccgccgtcatctgcgccaaacaccaaagcggctgggaaacgctcgcccttcaggacatttttccgccgcaggtttacgttgccaaacgcgagttgttcaaaatcccctttttcggctggggcttgaaactggtcaaaaccataggcatagaccgcaacaaccgccgcgaagccaacgagcagctcataaaacaggggttggtgcgcaaaaacgaaggctattggattaccattttccccgaaggcacgcgccttgcgcccggaaaacgcggcaaatacaaactcggcggcgcgcgcatggcgaaaatgtttgagatggacatcgtccccgtcgccctcaacagcggcgaattttggccgaaaaactcctttctgaaatatccgggggaaatcaccgtcgtcatctgtccgaccatcccgcacgcaagcggcagcgaagccgaattgatggaaaaatgcgaacatctcatcgaaacgcaacaaccgcttatttccggcgcaggcccgtttgccgccaaaatgccgtctgaaaccgcatga

SEQ ID NO: 40485 - protein, 247 aa, Neisseria meningitidis
MLIIRNLIYWLILCSTLIFLFPFMLLASPFRDGAHKMARVWVGILNWSLKHIVGLKYRIIGAENIPDRPAVICAKHQSGWETLALQDIFPPQVYVAKRELFKIPFFGWGLKLVKTIGIDRNNRREANEQLIKQGLVRKNEGYWITIFPEGTRLAPGKRGKYKLGGARMAKMFEMDIVPVALNSGEFWPKNSFLKYPGEITVVICPTIPHASGSEAELMEKCEHLIETQQPLISGAGPFAAKMPSETA

SEQ ID NO: 40486 - DNA, 744 bp, Neisseria meningitidis
atgctcatcatccgcaacctgatttactggctgatactctgttccaccctgattttcctctttccctttatgctgctcgcctcgcctttccgagacggggcgcacaagatggcgcgggtctgggtcaaaatcctcaacctctcgctcaaacacatcgtcgggctcaaataccgcatcatcggcgcggaaaacatccccgaccgccccgccgtcatctgcgccaaacaccaaagcggctgggaaacgctcgcccttcaggacatttttccgccgcaggtttacgttgccaaacgcgagttgttcaaaatcccctttttcggctggggcttgaaactggtcaaaaccataggcatagaccgcaacaaccgccgcgaagccaacgagcagctcataaaacaggggttggcgcgcaaaaacgaaggctattggattaccattttccccgaaggcacacgccttgcgcccggaaaacgcggcaaatacaaactcggcggcgcgcgcatggcgaaaatgtttgagatggacatcgtccccgtcgccctcaacagcggcgaattttggccgaaaaactcctttctgaaatatccgggggaaatcaccgtcgtcatctgtccgaccatcccgcacgcaagcggcagcgaagccgaattgatgggaaaatgcgaacacctcatcgaaacgcagcagccgctcatttccggcgcaggcccgtttgccgccaaaatgccgtctgaaaccgcatga

SEQ ID NO: 40487 - protein, 247 aa, Neisseria meningitidis
MLIIRNLIYWLILCSTLIFLFPFMLLASPFRDGAHKMARVWVKILNLSLKHIVGLKYRIIGAENIPDRPAVICAKHQSGWETLALQDIFPPQVYVAKRELFKIPFFGWGLKLVKTIGIDRNNRREANEQLIKQGLARKNEGYWITIFPEGTRLAPGKRGKYKLGGARMAKMFEMDIVPVALNSGEFWPKNSFLKYPGEITVVICPTIPHASGSEAELMGKCEHLIETQQPLISGAGPFAAKMPSETA

SEQ ID NO: 40488 - DNA, 1773 bp, Neisseria meningitidis
atgatactgccagcccgtttttcagacggcatcagcctttccctgcgcctgaaactcctgaccggactgtgggtcgggttggcggcattgtctgtcgttttgacactgctgctctctttgcgtctggaaaacgcggcctccgtcatcgaagaggcgggcaacttgagaatgcaggcataccgtctggcatacatggcgggtgaaggctcgccccgtgcgcaaattgacaatcaggttgccgaatttgaaaaaagtttaaaacgcattgcccaaagcgatgccatccatccgctgattccttcggacacccctcttgcttatgatttgatacaatccatgctgattatagattggcaggcacacatcctccccccgctccagtcctaccggcgaccgactcaggtcgatctctaccgctttgccggaaacatcgaactgtttttgcaggcattggaaaatgccaacgaaaaaaacacatggtggctcaggcgttttcaatgggcaattatgttgatgacgctggtgtcgtctgtactgatgctgttttggcaccagatttgggttatccggccgctgcaggcgttaagggaaggtgcggaacgcatcggacggaggtgtttcgatattccggttcccgaaggcggtacgccggaattcaaacaggtcgggcgttgtttcaatcaaatgggcggcaggttgaaaattttatatgatgatttggaaggacaagtcgccgagcagacacgcagtctcgaaaaacaaaatcaaaacctgaccctgctgtaccaaactacacgggacctgcaccaatcctacataccgcaacaggctgcagaacattttctaaaccgtatcctgcccgccgtaggagcagattccggcagagtttgtttggacggcggatccgatgtttatgtttccattcatcatgcggattgcggcacagcagcttcggatttggggaagtaccatgaggaaatcttccccattgagtaccagaacgaaacattgggcaggctgttgctcagctttccaaacggcatttctcttgatgaagacgaccgcatcctgcttcaaacactaggcaggcaattgggcgtatcgcttgccggcgcaaaacaggaggaagaaaaacgcctgcttgcagtattgcaggaacgcaacctgattgcgcaaggattacatgacagcatcgcacaagcattaacgttcctaaacctacaggtacagatgctggaaaccgcctttgccgaaaacaaacgggaggaagccgcagaaaacatcagctttatcaaaacaggcgtgcaggaatgttatgaagatgtccgcgaactgctgctcaacttccgtaccaaaatcagcaataaagaatttcccgaagccgttgccgacctattcgcccgctttacgcaacaaaccgggataacggtcgaaaccgcctgggaaaacggttcgttcctgccgcctcaggaagcgcagctccaaatgatttttatcctgcaggaaagcctgtccaacatccgcaaacacgcccgcgccacccatgtaaaattcaccctttccgaacacggcggacgctttaccatgaccatccaagacaacggacaaggtttcgacacggagaaaataggagaacccacgggcagccatgtcggactgcacatcatgcaggagcgtgccaaacgcatccatgccgttttagaaatccgttcccaagctcaacagggaaccaccgtctcattgacggttgcatctgaagaaagcttgaaatga

SEQ ID NO: 40489 - protein, 590 aa, Neisseria meningitidis
MILPARFSDGISLSLRLKLLTGLWVGLAALSVVLTLLLSLRLENAASVIEEAGNLRMQAYRLAYMAGEGSPRAQIDNQVAEFEKSLKRIAQSDAIHPLIPSDTPLAYDLIQSMLIIDWQAHILPPLQSYRRPTQVDLYRFAGNIELFLQALENANEKNTWWLRRFQWAIMLMTLVSSVLMLFWHQIWVIRPLQALREGAERIGRRCFDIPVPEGGTPEFKQVGRCFNQMGGRLKILYDDLEGQVAEQTRSLEKQNQNLTLLYQTTRDLHQSYIPQQAAEHFLNRILPAVGADSGRVCLDGGSDVYVSIHHADCGTAASDLGKYHEEIFPIEYQNETLGRLLLSFPNGISLDEDDRILLQTLGRQLGVSLAGAKQEEEKRLLAVLQERNLIAQGLHDSIAQALTFLNLQVQMLETAFAENKREEAAENISFIKTGVQECYEDVRELLLNFRTKISNKEFPEAVADLFARFTQQTGITVETAWENGSFLPPQEAQLQMIFILQESLSNIRKHARATHVKFTLSEHGGRFTMTIQDNGQGFDTEKIGEPTGSHVGLHIMQERAKRIHAVLEIRSQAQQGTTVSLTVASEESLK

SEQ ID NO: 40490 - DNA, 1773 bp, Neisseria meningitidis
atgatactgccagcccgtttttcagacggcatcagcctttccctgcgcctgaaactcctgaccggactgtgggtcgggttggcggcattgtctgtcgttttgacactgctgctctctttgcgtctggaaaacgcggcctccgtcatcgaagaggcgggcaacttgagaatgcaggcataccgtctggcatacatggcgggtgaaggctcgccccgtgcgcaaattgacaatcaggttgccgaatttgaaaaaagtttaaaacgcattgcccaaagcgatgccatccatccgctgattccttcggacacccctcttgcttatgatttgatacaatccatgctgattatagattggcaggcacacatcctccccccgctccagtcctaccggcgaccgactcaggtcgatctctaccgctttgccggaaacatcgaactgtttttgcaggcattggaaaatgccaacgaaaaaaacacatggtggctcaggcgttttcaatgggcaattatgttgatgacgctggtgtcgtctgtactgatgctgttttggcaccagatttgggttatccggccgctgcaggcgttaagggaaggtgcggaacgcatcggacggaggtgtttcgatattccggttcccgaaggcggtacgccggaattcaaacaggtcgggcgttgtttcaatcaaatgggcggcaggttgaaaattttatatgatgatttggaaggacaagtcgccgagcagacacgcagtctcgaaaaacaaaatcaaaacctgaccctgctgtaccaaactacacgggatctgcaccaatcctacataccgcaacaggctgcagaacattttctaaaccgtatcctgcccgccgtaggagcagattccggcagagtttgtttggacggcggatccgatgtttatgtttccattcatcatgcggattgcggcacagcagcttcggatttggggaagtaccatgaggaaatcttccccattgagtaccagaacgaaacattgggcaggctgttgctcagctttccaaacggcatttctcttgatgaagacgaccgcatcctgcttcaaacactaggcaggcaattgggcgtatcgcttgccggcgcaaaacaggaggaagaaaaacgcctgcttgcagtattgcaggaacgcaacctgattgcgcaaggattacatgacagcatcgcacaagcattaacgttcctaaacctacaggtacagatgctggaaaccgcctttgccgaaaacaaacgggaggaagccgcagaaaacatcggcttcatcaaaacaggcgtgcaggaatgttatgaagatgtccgcgaactgctgctcaacttccgtaccaaaatcagtaataaagaatttcccgaagccgttgccgacctattctcgcgctttacgcaacagaccggcacgactgtcgaaaccgcttgggaaaacggcacgcacctgcctacacaggacgagcagctccaaatgattttcatcctgcaagaaagcttgtccaacatccgaaaacatgcccacgccacccatatcaaattcagactgctcaaacaggatggaagttttacaatgaccattcaagacaacggacagggttttgacacggaaaacattggagaaccatcgggcagccatgtcggactgcatatcatgcaggagcgtgccaaacgcatccatgccgttttagaaatccgttcccaagctcaacagggaaccaccgtctcattgacggttgcatctgaagaaagcttgaaatga

SEQ ID NO: 40491 - protein, 590 aa, Neisseria meningitidis
MILPARFSDGISLSLRLKLLTGLWVGLAALSVVLTLLLSLRLENAASVIEEAGNLRMQAYRLAYMAGEGSPRAQIDNQVAEFEKSLKRIAQSDAIHPLIPSDTPLAYDLIQSMLIIDWQAHILPPLQSYRRPTQVDLYRFAGNIELFLQALENANEKNTWWLRRFQWAIMLMTLVSSVLMLFWHQIWVIRPLQALREGAERIGRRCFDIPVPEGGTPEFKQVGRCFNQMGGRLKILYDDLEGQVAEQTRSLEKQNQNLTLLYQTTRDLHQSYIPQQAAEHFLNRILPAVGADSGRVCLDGGSDVYVSIHHADCGTAASDLGKYHEEIFPIEYQNETLGRLLLSFPNGISLDEDDRILLQTLGRQLGVSLAGAKQEEEKRLLAVLQERNLIAQGLHDSIAQALTFLNLQVQMLETAFAENKREEAAENIGFIKTGVQECYEDVRELLLNFRTKISNKEFPEAVADLFSRFTQQTGTTVETAWENGTHLPTQDEQLQMIFILQESLSNIRKHAHATHIKFRLLKQDGSFTMTIQDNGQGFDTENIGEPSGSHVGLHIMQERAKRIHAVLEIRSQAQQGTTVSLTVASEESLK

SEQ ID NO: 40492 - DNA, 627 bp, Neisseria gonorrhoeae
atggcaagcccgtcgagtctgcctttcaattcgggcaagaccaaaccgacggcttttgccgcgccggttttggtcggaatcatgttttccacgccgctgcgggcgcggcgcaggtctttgtggcgcacgtcggtaacggtttggtcgttggtcagtgcgtggatggtggtcattgcgcctttgacgatgccgacgctttcgctcaacactttggcaaccggcgagaggcagttggtggtgcaggaagcgttggaaacgacggtcatgtcggcggtcaggacgctgtcgttcacgccgtacacgacggttgcatcgacatcgtcgccgcccggtgcggaaatgaggacttttttcgcgccgctttcgaggtggattttggctttttctttgctggtgaacgcgccggtgcattccatgaccaaatcgacaccgagttctttccacggcagttcggcagggttgcgggtcgagaagaaggggattttgtcgccgttgacgatgaggttgccgccgtcgtgggatacgtcggcttcaaagcgtccgtgtacggtgtcgaatttggtcagatgggcgttggtttcaaggctgccgctggcgttgacggcgacgatttggagttggtcttga

SEQ ID NO: 40493 - protein, 208 aa, Neisseria gonorrhoeae
MASPSSLPFNSGKTKPTAFAAPVLVGIMFSTPLRARRRSLWRTSVTVWSLVSAWMVVIAPLTMPTLSLNTLATGERQLVVQEALETTVMSAVRTLSFTPYTTVASTSSPPGAEMRTFFAPLSRWILAFSLLVNAPVHSMTKSTPSSFHGSSAGLRVEKKGILSPLTMRLPPSWDTSASKRPCTVSNLVRWALVSRLPLALTATIWSWS

SEQ ID NO: 40494 - DNA, 627 bp, Neisseria meningitidis
atggcaagcccgtcgagcctgcctttcaattcgggcagtaccaaaccgacggcttttgccgcgccggttttggtcggaatcatgttttccacgccgctgcgggcgcggcgcaggtctttgtggcgcacgtcggtaacggtttggtcgttggtcagcgcgtggatggtggtcatcgcgcctttgacgatgccgacgctttcgctcaacactttggcaaccggcgagaggcagttggtggtgcaggaagcgttggaaacgacggtcatgtcggcggtcaggacgctgtcgttcacgccgtacacgacggttgcatcgacatcgtcgccgcccggtgcggaaatgaggacttttttcgcgccgctttcgaggtggattttggctttttctttgctggtgaacgcgccggtgcattccatgaccaaatcgacaccgagttctttccacggcagttcggcagggttgcgggtcgagaagaaggggattttgtcgccgttgacgatgaggttgccgccgtcgtgggatacgtcggcttcaaagcgtccgtgcacggtgtcgaatttggtcagatgggcgttggtttcaaggctgccgctggcgttgacggcgacgagttggagttggtcttga

SEQ ID NO: 40495 - protein, 208 aa, Neisseria meningitidis
MASPSSLPFNSGSTKPTAFAAPVLVGIMFSTPLRARRRSLWRTSVTVWSLVSAWMVVIAPLTMPTLSLNTLATGERQLVVQEALETTVMSAVRTLSFTPYTTVASTSSPPGAEMRTFFAPLSRWILAFSLLVNAPVHSMTKSTPSSFHGSSAGLRVEKKGILSPLTMRLPPSWDTSASKRPCTVSNLVRWALVSRLPLALTATSWSWS

SEQ ID NO: 40496 - DNA, 627 bp, Neisseria meningitidis
  misc_feature (469)..(469): n is a, c, g, or t
  misc_feature (477)..(477): n is a, c, g, or t
atggcaagcccgtcgagtttgtctttcaattcgggcagtaccaaaccgacggcttttgccgcgccagttttggtcggaatcatgttttccacgccgctgcgggcgcggcgcaggtctttgtggcgcacgtcggtaacggtttggtcgttggtcagcgcgtggatggtggtcatcgcgcctttgacgatgccgacgctttcgctcaacactttggcaaccggcgagaggcagttggtggtgcaggaagcgttggaaacgacggtcatgtcggcggtcaggatgctgtcgttcacgccgtacacgacggttgcatcgacatcgtcgccgcccggtgcggaaatgaggacttttttcgcgccgctttccagatgaactttggctttttctttgctggtgaacgcgccggtgcattccatgaccaaatcgacaccgagttctttccacggcagttcggcagggttgcgggtcnagaagaangggattttgtcgccgttgacgatgaggttgccgccgtcgtgggatacgtcggcttcaaagcgtccgtgcacggtgtcgaatttggtgaggtgggcgttggtttcaaggctgccgctggcgttgacggcgacgatttggagttggtcttga

SEQ ID NO: 40497 - protein, 207 aa, Neisseria meningitidis
  misc_feature (156)..(156): Xaa can be any naturally occurring amino acid
  misc_feature (158)..(158): Xaa can be any naturally occurring amino acid
MASPSSLSFNSGSTKPTAFAAPVLVGIMFSTPLRARRRSLWRTSVTVWSLVSAWMVVIAPLTMPTLSLNTLATGERQLVVQEALETTVMSAVRMLSFTPYTTVASTSSPPGAEMRTFFAPLSRTLAFSLLVNAPVHSMTKSTPSSFHGSSAGLRVXKXGILSPLTMRLPPSWDTSASKRPCTVSNLVRWALVSRLPLALTATIWSWS

SEQ ID NO: 40498 - DNA, 6147 bp, Neisseria gonorrhoeae
atgaacaaaaccctctatcgtgtgattttcaaccgcaaacgcggtgctgtggtagctgttgccgaaaccaccaagcgcgaaggtaaaagctgtgccgatagtggttcgggcagcgtttatgtgaaatccgtttctttcattcctactcattccaaagccttttgtttttctgcattaggcttttctttatgtttggctttgggtacggtcaatattgcttttgctgacggcattattactgataaagctgctcctaaaacccaacaagccacgattctgcaaacaggtaacggcataccgcaagtcaatattcaaacccctacttcggcaggggtttctgttaatcaatatgcccagtttgatgtgggtaatcgcggggcgattttaaacaacagtcgcagcaacacccaaacacagctaggcggttggattcaaggcaatccttggttgacaaggggcgaagcacgtgtggttgtaaaccaaatcaacagcagccatccttcacaactgaatggctatattgaagtgggtggacgacgtgcagaagtcgttattgccaatccggcagggattgcagtcaatggtggtggttttatcaatgcttcccgtgccactttgacgacaggccaaccgcaatatcaagcaggagactttagcggctttaagataaggcaaggcaatgctgtaatcgccggacacggtttggatgcccgtgataccgatttcacacgtattcttttgtatgccaacaaaatcaccttgatcagtacggccgaacaagcaggcattcgtaatcaagggcagttgtttgcttcttccggtaatgtggcgattgatgcaaatggccgtttggtcaatagtggcacgatggctgccgccaatgtgcaagatatgaataatacagcggaacacaaagtcaatatccgcagtcaagcctttgaaaacagcggtacggcggtatcgcaacaaggcactcaaattcacagtcaatcgattcaaaacactggcaaattattgtcggcaggaacagaggatttagccgtttcaggcagcctgaacaatcaaaatggcgaaatagcgaccaatcaacaactgattattcacgatggtcagcaatctaccgttgtcattgataatacgaatggcacgatacaatcaggccgtgatgttgccattcaggcaaaatcgttatccaacaacggcacacttgccgctgataataaactggatattgcgttacaagatgatttttatgtagaacgcaagatcgtggcgggcaatgaattgtcgctcagtacacgaggcagcctgaaaaattcacataccttgcaagcaggaaaacgcattcggattaaagcaaataaccttgataatgcagtacaaggcaacattcaatccggcggtacgacagacattggcacgcagcacaatttaaccaatagaggcttgattgacggacaacaaaccaaaatccaagccgggcaaatgaataatatcggtacaggtcggatttatggcgacaatatcgctattgcggctacccgcttagacaatcaagatgaaaacggtacaggtgccgccattgcggcacgcgaaaacctgaatttaggcattgaacaattaaataaccgtgaaaacagtctgatttacagcggtaacgatatggcggttggcggcgcattagataccaatgaccaagccacaggcaaagcccaaaggatacacaatgccggcgcaatcattgaagctgcaggcaaaatgcgtttaggtgtagaaaagctgcacaataccaatgagcatttgaaaacgcagttggtagaaacagggcgcgagcgtattgttgattacgaagcatttggacgacacgaattattgcgagaaggcacgcaacatgaattaggctggtttgtctacaacaatgaatcagaccacttacgcacccctgatggagtggcgcatgaaaattggcataaatacgattatgaaaaagtaacgcaagaaactcaagtaaccggaactgcgcctgctaaaatcattgcaggtagcgatttgattattgatagcaaagcagtcttcaacagcgacagccgaatcattgccggcggccaattgcttgtgcaaacagaaaaagacggtttgcataacgagcaaacctttggcgagaagaaagtcttcagcgaaaatggtaagttgcacaactactggcgtgcgcgtcgtaaaggacatgatgaaacagggcatcgtgaacaaaattatactttgccggaggaaatcacacgcgacatttcactgggttcatttgcctatgaatcgcatagcaaagcattaagccgtcatgcgcccagccaaggcactgagttgccacaaagtaaccgggataatatccgtactgcgaaaagcaacggtatttcgctaccctatacgcccaattcttttaccccattacccggcagcagcttatacattatcaatcctgccaataaaggctatcttgttgaaaccgatccacgctttgccaactaccgtcaatggttgggtagtgactatatgctgggcagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagcagcgcaactgaccagcgatattgtttggttggtacaaaaagaagttaaacttcctgatggcggcacacaaaccgtattgatgccacaggtttatgtacgcgttaaaaatggcggcatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcattctttctgccgaacagacattattgctcaatgcgggtaacaacatcaacaaccaaagcacggccaagagcagtcaaaatgcacaaggtagcagcacctacctagaccgaatggcaggtatttatatcacaggcaaagaaaaaggtgttttagcagcgcaggcaggcaaagacatcaacatcattgccggtcaaatcagcaatcaatcagatcaagggcaaacccggctgcaggcaggacgcgacattaacctggatacggtacaaaccggcaaatatcaagaaatccattttgatgccgataaccataccatccgaggttcaacgaacgaagtcggcagcagcattcaaacaaaaggcgatgttaccctattgtcagggaataatctcaatgccaaagctgccgaagtcggcagcgcaaaaggcacacttgccgtgtatgctaaaaatgacattactatcagctcaggcatccatgccggccaagttgatgatgcgtccaaacatacaggcagaagcggcggcggtaataaattagtcattaccgataaagcccaaagtcatcacgaaactgctcaaagcagcacctttgaaggcaagcaagttgtattgcaggcaggaaacgatgccaacatccttggcagtaatgttatttccgataatggcacccggattcaagcaggcaatcatgttcgcattggtacaacccaaactcaaagccaaagcgaaacctatcatcaaacccaaaaatcaggattgatgagtgcaggtatcggcttcactattggcagcaagacaaacacacaagaaaaccaatcccaaagcaacgaacatacaggcagtaccgtaggcagcctgaaaggcgataccaccattgttgcaagcaaacactacgaacaaaccggcagcaacgtttccagccctgagggcaacaaccttatcagcacgcaaagtatggatattggcgcagcacaaaaccaattaaacagcaaaaccacccaaacctacgaacaaaaaggcttaacggtgggcattcagttcgcccgttaccgatttggcacaacaagcgattgccgtagcacacaaagcagcaaacaagtcggacaaagcaaaaacgaccgcgttaatgccatggcggctgccaatgcaggttggcaggcctatcaaacaggcaaaggcgcacaaaacttagccaatggtacaaccaatgccaaacaagtcagcatctccataacctacggcgaacagcaaaaccgacaaaccacccaagttcaagccaatcaagcccaagcgagtcaaattcaagcaggcggcaaaactaccctttattgccgaaggtgcggcgaacaatccaatatcaacatcacaggctcaggtgtttcaggcagagcaggaaccggcctgattgccgataagcaaatccatctgcaatcagccgagcaaagcaataccgaacgcagccaaaacaaatcagcaggctggaacgcaggtgctgccgtatcattcggacaaggaggctggtcattaggcgttgccgcaggcggcaatgtcggcaaaggctacggctatggcgatagcgtaacccaccgccatagccatattggcgacaaaggcagccaaacccttatccaaagtggtggcgataccatcatcaaaggcgcgcaagtacgcggcaaaggcgtacaagtcaatgccaaaaacctaagcattcaaagtgtacaagatagagaaacttatcaaagcaaacaacaaaacgccggtgcacaagttaccgtaggttatggcttcagtgccagtggcgattacagccaaagcaaaatccgagccgaccatgcttcggtaaccgagcaaagcggtatttatgccggagaagacggctatcaaatcaaggtcggaaaccatacaggcctcaaaggcggcatcatcaccagcagccaaagcgcaaaagacaagggtaaaaaccgattcagcacaggcacactcgccggcagtgatattcaaaattacagccaatacgaaggaaaaagttttggattgggtgccagcgttgccgtaagcggcaaaacactgggacagggcgcaaaaaataaacctcaagacaaacacctgacaagcatagccgataaaaacggcgcaagttcatcagtagggtacggcagcgacagcgacagtcaaagcagcatcacaaaaagcggcatcaatacccccaaaaacattcaaatcacagacgaagccgcacaaatcaggctgacaggcaaaatagcggcacaaaccaaagccgatattgatacaaacgtaaccacagacaccgccgaacgacattcgggcagcctgaaaaacatatttgacaaagatagagtgcaaagtgaactggatttacaaagaaccgtcagccaagattttagtaaaaatgttcaacaaaccaataccgagattaaccaacatttagacaaactcaaagcagacaaagaagcagccgaaacagcagcagccgaggcattagccaatggcgatatggaaactgccaaacgcaaagcccatgaagctcaagatgcggcagcaaaagcagataattggcaacaaggcaaagtcattctcaacatgttagcctcaggtttagctgagccgacccaaagcggagcgggcatcgctgcggctaccgcatcgccagacgtatcgtatgcgattggacagcactttaaagatttagccggtcaaaacgcgaatggcaaactaaccgccagtcaagaaaccgctcacgttcttgcccacgcggtattaggagcagcggttgccgcagcatgaggcaacaatgccccggcaggagcattgggtgcgggcgggtcggaagcggccgccccaatcatcggcaaatggctgtacggcaaaggagacggcggcagcctgaatgcggaggaaaaagagaccgtttcggcgattacaaggatgctgggtacggctgccggagcagctgagggaaactcgtccgccgatgctgtgtggggttgttttcaaacggcttcagatttcgcttcctctttttcatatcctataaacatgtga

SEQ ID NO: 40499 - protein, 2048 aa, Neisseria gonorrhoeae
  misc_feature (1963)..(1963): Xaa can be any naturally occurring amino acid
MNKTLYRVIFNRKRGAVVAVAETTKREGKSCADSGSGSVYVKSVSFIPTHSKAFCFSALGFSLCLALGTVNIAFADGIITDKAAPKTQQATILQTGNGIPQVNIQTPTSAGVSVNQYAQFDVGNRGAILNNSRSNTQTQLGGWIQGNPWLTRGEARVVVNQINSSHPSQLNGYIEVGGRRAEVVIANPAGIAVNGGGFINASRATLTTGQPQYQAGDFSGFKIRQGNAVIAGHGLDARDTDFTRILLYANKITLISTAEQAGIRNQGQLFASSGNVAIDANGRLVNSGTMAAANVQDMNNTAEHKVNIRSQAFENSGTAVSQQGTQIHSQSIQNTGKLLSAGTEDLAVSGSLNNQNGEIATNQQLIIHDGQQSTVVIDNTNGTIQSGRDVAIQAKSLSNNGTLAADNKLDIALQDDFYVERKIVAGNELSLSTRGSLKNSHTLQAGKRIRIKANNLDNAVQGNIQSGGTTDIGTQHNLTNRGLIDGQQTKIQAGQMNNIGTGRIYGDNIAIAATRLDNQDENGTGAAIAARENLNLGIEQLNNRENSLIYSGNDMAVGGALDTNDQATGKAQRIHNAGAIIEAAGKMRLGVEKLHNTNEHLKTQLVETGRERIVDYEAFGRHELLREGTQHELGWFVYNNESDHLRTPDGVAHENWHKYDYEKVTQETQVTGTAPAKIIAGSDLIIDSKAVFNSDSRIIAGGQLLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVGIQFARYRFGTTSDCRSTQSSKQVGQSKNDRVNAMAAANAGWQAYQTGKGAQNLANGTTNAKQVSISITYGEQQNRQTTQVQANQAQASQIQAGGKTTLYCRRCGEQSNINITGSGVSGRAGTGLIADKQIHLQSAEQSNTERSQNKSAGWNAGAAVSFGQGGWSLGVAAGGNVGKGYGYGDSVTHRHSHIGDKGSQTLIQSGGDTIIKGAQVRGKGVQVNAKNLSIQSVQDRETYQSKQQNAGAQVTVGYGFSASGDYSQSKIRADHASVTEQSGIYAGEDGYQIKVGNHTGLKGGIITSSQSAKDKGKNRFSTGTLAGSDIQNYSQYEGKSFGLGASVAVSGKTLGQGAKNKPQDKHLTSIADKNGASSSVGYGSDSDSQSSITKSGINTPKNIQITDEAAQIRLTGKIAAQTKADIDTNVTTDTAERHSGSLKNIFDKDRVQSELDLQRTVSQDFSKNVQQTNTEINQHLDKLKADKEAAETAAAEALANGDMETAKRKAHEAQDAAAKADNWQQGKVILNMLASGLAEPTQSGAGIAAATASPDVSYAIGQHFKDLAGQNANGKLTASQETAHVLAHAVLGAAVAAAXGNNAPAGALGAGGSEAAAPIIGKWLYGKGDGGSLNAEEKETVSAITRMLGTAAGAAEGNSSADAVWGCFQTASDFASSFSYPINM

SEQ ID NO: 40500 - DNA, 7545 bp, Neisseria meningitidis
atgaataaaactctctatcgtgtaattttcaaccgcaaacgtggggctgtggtagccgttgctgaaactaccaagcgcgaaggtaaaagctgtgccgatagtgattcaggcagcgctcatgtgaaatctgttccttttggtactactcatgcacctgtttgtcgttcaaatatcttttctttttctttattgggcttttctttatgtttggctgtaggtacggccaatattgcttttgctgatggcattattgctgataaagctgctcctaaaactcaacaagccacgattctgcaaacaggtaacggcataccgcaagtcaatattcaaacccctacttcggcaggggtttctgttaatcaatacgcccagtttgatgtgggtaatcgcggggcgattttaaacaacagccgcagcaacacccaaacacagctaggcggttggattcaaggtaatccttggttggcaaggggcgaagcacgtgtggttgtaaaccaaatcaacagcagccattcttcacaaatgaatggctatattgaagtgggcggacgacgtgcagaagtcgttattgccaatccggcagggattgcagtcaatggtggtggttttatcaatgcttcccgtgccactttgacgacaggccaaccgcaatatcaagcaggagaccttagcggctttaagataaggcaaggcaatgttgtaatcgccggacacggtttggatgcccgtgataccgatttcacacgtattctcagttatcattccaaaattgatgcacccgtatggggacaagatgttcgtgtcgtcgcgggacaaaacgatgtggtcgcaacaggtaatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggccgagcaagcaggcattcgtaatcaagggcagttgtttgcttcttccggtaatgtggcgattgatgcaaatggccgtttagtcaatagtggcacgatggctgccgccaatgcgaaagatacggataatacagcggaacacaaagtcaatatccgcagtcagggcgttgaaaacagcggtacggcggtatcgcaacaaggcactcaaattcacagtcagtcgattcaaaacactggcacattattgtcctcaggcgaaatattgattcacaattcgggcagcctgaaaaatgaaacatcaggcaccattgaagccgctcgtttggctattgataccgacacacttaataatcaaggcaaactctctcaaacaggttcacaaaaactccatattgatgcacaaggcaaaatggataaccgtggccgcatgggtttacaagataccgcaccaaccgcgtcaaatggttcaagcaatcaaaccggcaatagttacaatgcatctttccattcatccactaccacaccaacaacggcaacaggtacgggtactgcaaccgtttctatatcaaacataactgcgcctacctttgctgatgggacaattcgcactcatggtgcactggataattcaggcagtattattgccaatggtcaaacagatgttagtgcgcaacaaggtttaaataatgcaggacaaatagacattcatcagttaaatgcaaaaggttcggcgtttgacaatcacaatggaacaattatcagtgatgcggtccacattcaagccggcagcctgaataatcaaaatggcaacatcacaacacgccaacagttagagattgaaaccgatcaactggataacgctcatggcaagttattatcagcagaaatagcggatttagccgtttcaggcagcctgaacaatcaaaatggcgaaatagcgaccaatcaacaactgattattcacgatggtcagcaatctaccgctgtcattgataatacgaatggcacgatacaatcaggccgtgatgttgctattcaggcaaaatcgttatccaacaacggcacacttgccgctgataataaactggatattgcgttacaagatgatttttatgtagaacgcaatatcgtggcgggcaatgaattgtcgctcagtacacgaggcagcctgaaaaattcacatactttgcaagcaggaaaacgcattcggattaaagcaaataaccttgataatgcagcacaaggcaacattcaatccggcggtacgacagacattggcacgcagcacaatttaaccaatagaggcttgattgacggacaacaaaccaaaatccaagccgggcaaatgaataatatcggtacaggtcggatttatggcgacaatatcgctattgcggctacccgcttagacaatcaagatgaaaacggtacaggtgccgccattgcggcacgtgaaaacctgaatttaggcatcggacaattaaacaaccgtgaaaacagtctgatttacagcggtaacgatatggcggttggcggcgcattagataccaatggccaagccacaggcaaagcccaaaggatacacaatgccggcgcaaccattgaagctgcaggcaaaatgcgtttaggtgtagaaaagctgcacaataccaatgagcatttgaaaacgcagttggtagaaacagggcgcgagcatattgttgattacgaagcatttggacgacacgaattattgcgagaaggcacgcaacatgaattaggctggtctgtctataacgatgaatcagaccacttacgcacccctgatggagcggcgcatgaaaattggcataaatacgattatgaaaaagtcacccaaaaaacccaagttacccaaactgcgccagccaaaatcatttcaggtaatgatttaaccattgatggtaaagaagtatttaataccgatagccaaatcattgctggtggcaatctcattgtacaaacagaaaaagacggtttgcataacgagcaaacctttggcgaaaagaaagtattcagtgaaaatggcaaattacacagctattggcgtgagaaacataaaggacgagactcaacgggacatagcgaacaaaattacactttgccggaggaaatcacacgcaacatttcactgggttcatttgcctatgaatcgcatcgcaaagcattaagccatcatgcgcccagccaaggcactgagttgccgcaaagcaacggtatttcgctaccctatacgtccaattcttttaccccattacccagcagcagcttatacattatcaatcctgtcaataaaggctatcttgttgaaaccgatccacgctttgccaactaccgtcaatggttgggtagtgactatatgctggacagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagtagcgcaactgaccagcgatattgtttggttggtacaaaaagaagttaagcttcctgatggcggcacacaaaccgtattggtgccacaggtttatgtacgcgttaaaaatggcgacatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcatgctttctgccgaacagacattattgctcaacgcaggcaacaacatcaacagccaaagcaccaccgccagcagtcaaaatacacaaggcagcagcacctacctagaccgaatggcaggtatttatatcacaggcaaagaaaaaggtgttttagcagcgcaggcaggaaaagacatcaacatcattgccggtcaaatcagcaatcaatcagagcaagggcaaacccggctgcaagcagggcgcgacattaacctagatacggtacaaaccagcaaacatcaagcaacccattttgatgccgataaccatgttattcgcggttcaacgaacgaagtcggcagcagcattcaaacaaaaggcgatgttaccctattgtcagggaataacctcaatgccaaagctgccgaagtcagcagcgcaaacggtacactcgctgtgtctgccaaaaatgacatcaacatcagcgcaggcatcaacacgacccatgttgatgatgcgtccaaacacacaggcagaagcggtggtggcaataaattagtcattaccgataaagcccaaagtcatcacgaaaccgcccaaagcagcacctttgaaggcaagcaagttgtattgcaggcaggaaacgatgccaacatccttggcagcaatgttatttccgataatggcacccagattcaagcaggcaatcatgttcgcattggtacaacccaaactcaaagccaaagcgaaacctatcatcaaacccagaaatcaggattgatgagtgcaggtatcggcttcactattggcagcaagacaaacacacaagaaaaccaatcccaaagcaacgaacatacaggcagtaccgtaggcagcttgaaaggcgataccaccattgttgcaggcaaacactacgaacaaatcggcagtaccgtttccagcccggaaggcaacaataccatctatgcccaaagcatagacattcaagcggcacacaacaaattaaacagtaataccacccaaacctatgaacaaaaaggcctaacggtggcattcagttcgcccgttaccgatttggcacaacaagcgattgccgtagcacaaagcagcaaacaagtcggacaaagcaaaaacgaccgcgttaatgccatggcggctgccaatgcaggctggcaagcctatcaaacaggtaagagtgcacaaaacttagccaatggtacaaccaatgccaaacaagtcagcatctccataacctacggcgaacagcaaaaccgacaaaccacccaagttcaagccaatcaagcccaagcgagtcaaattcaagcaggtggtaaaaccacattaatcgccacaggcgcagcagaacaatccaatatcaacatcgcaggctcagatgttgccggcaaagcaggcacaatcctgattgccgataacgacatcacactccaatcagccgagcaaagcaataccgaacgcggccaaaacaaatcggcaggctggaacgcaggtgctgccgtatcattcggacaaggaggctggtcattaggcgttaccgcaggcggcaatgtcggcaaaggctacggcaatggcgacagcatcacccaccgccatagccatatcggcgacaaaggcagccaaacccttatccaaagcggtggcgacactaccatcaaaggcgcgcaagtacgcggcaaaggcgtacaagtcaatgccaaaaacctaagtattcaaagcgtacaagatagagaaacctatcaaagcaaacaacaaaacgccagtgcacaagttaccgtaggttatggcttcagtgccggtggcgattacagccaaagcaaaatccgagccgaccatgtttcagtaaccgagcaaagcggtatttatgccggagaagacggctatcaaatcaaggtcggaaaccatacagacctcaaaggcggcatcatcaccagtacccaaagcgcagaagacaagggtaaaaaccgctttcagacggccaccctcacccatagcgacatcaaaaaccacagccaatacaaaggcgaaagttttggattgggcgcaagtgcgtccataagcggcaaaacactgggacagggcgcacaaaataaacctcaaaacaaacacctgacaagcgtagccgataaaaacagcgcaagttcatcagtgggttatggcagcgacagcgacagtcaaagcagcatcacaaaaagcggcatcaacacccgcaacattcaaatcaccgacgaagccgcacaaatccggctgacaggcaaaacagcggcacaaaccaaagccgatattgatacaaacgtaaccacagacaccgccgaacgacattcgggcagcttgaagaacaccttcaacaaagaagcggtgcaaagtgaactggatttacaaagaaccgtcagccaagattttagtaaaaatgttcaacaagccaataccgagattaaccaacatttagacaaactcaaagcagacaaagaagcagccgaaacagcagcagccgaggcattagccaatggcgatatggaaactgccaaacgcaaagcccatgaagctcaagatgcggcagcaaaagcagataattggcaacaaggcaaagtcattctcaacatgttagcctcaggtttagctgcgccgacccaaagcggagcgggcatcgctgcggctaccgcatcgccagccgtatcgtatgcgattggacagcactttaaagatttagccggtcaaaacgcgaatggtaaactaaccgccagtcaagaaaccgcacacgttcttgcccacgcggtattaggagcagcggttgccgcagtaggagacaacaatgctctagcaggagcattgagtgcgggcgggtcggaagcggctgcgccttacatcagcaaatggttatacggcaaagaaaaaggaagcgacttaacggcggaagagaaagagactgtaacagcgattacaaatgtattgggtacggctacgggtgcggcagtcggcaacagcgcaacagatgcagcgcaaggcagcctgaatgcgcaaagtgcggtggagaataatgatactgtagagcaagtgaaatttgctcttaggcaccctagaattgctattgcaattggatctgtacataaagatcctggctctacattagagcctaatatttcaacaattgcttcaacttttcaattaaatttatttcctaatagtgaatttggtggtgaaggtggagttggcaatgcattcaggcacgttttatggcaagcaaccatcacacgagaatttggcaaagatattgctgttaaagtaggaaatagtcatgaaagtggggaaaaaattaattattctataagacgtaatctttcattagataaagcagatgaaatgattgatcaactaaataacgaaataggaagagaaatagcattaaataccaataggttaaacacaaaagagttagttggattaattctggaaacttataaaaataatggtttttatcaagcagaaagaaacagtaatggaaattatgatgttgtaagaaaaagattatctgaaaaagattaccagaatacaagcaatatattgattcacttagataatactggtgccggatttaaaattcagcagaggagaaaacaaatcagagcacaaatttcagccagacaatggagaagataa

SEQ ID NO: 40501 - protein, 2514 aa, Neisseria meningitidis
MNKTLYRVIFNRKRGAVVAVAETTKREGKSCADSDSGSAHVKSVPFGTTHAPVCRSNIFSFSLLGFSLCLAVGTANIAFADGIIADKAAPKTQQATILQTGNGIPQVNIQTPTSAGVSVNQYAQFDVGNRGAILNNSRSNTQTQLGGWIQGNPWLARGEARVVVNQINSSHSSQMNGYIEVGGRRAEVVIANPAGIAVNGGGFINASRATLTTGQPQYQAGDLSGFKIRQGNVVIAGHGLDARDTDFTRILSYHSKIDAPVWGQDVRVVAGQNDVVATGNAHSPILNNAAANTSNNTANNGTHIPLFAIDTGKLGGMYANKITLISTAEQAGIRNQGQLFASSGNVAIDANGRLVNSGTMAAANAKDTDNTAEHKVNIRSQGVENSGTAVSQQGTQIHSQSIQNTGTLLSSGEILIHNSGSLKNETSGTIEAARLAIDTDTLNNQGKLSQTGSQKLHIDAQGKMDNRGRMGLQDTAPTASNGSSNQTGNSYNASFHSSTTTPTTATGTGTATVSISNITAPTFADGTIRTHGALDNSGSIIANGQTDVSAQQGLNNAGQIDIHQLNAKGSAFDNHNGTIISDAVHIQAGSLNNQNGNITTRQQLEIETDQLDNAHGKLLSAEIADLAVSGSLNNQNGEIATNQQLIIHDGQQSTAVIDNTNGTIQSGRDVAIQAKSLSNNGTLAADNKLDIALQDDFYVERNIVAGNELSLSTRGSLKNSHTLQAGKRIRIKANNLDNAAQGNIQSGGTTDIGTQHNLTNRGLIDGQQTKIQAGQMNNIGTGRIYGDNIAIAATRLDNQDENGTGAAIAARENLNLGIGQLNNRENSLIYSGNDMAVGGALDTNGQATGKAQRIHNAGATIEAAGKMRLGVEKLHNTNEHLKTQLVETGREHIVDYEAFGRHELLREGTQHELGWSVYNDESDHLRTPDGAAHENWHKYDYEKVTQKTQVTQTAPAKIISGNDLTIDGKEVFNTDSQIIAGGNLIVQTEKDGLHNEQTFGEKKVFSENGKLHSYWREKHKGRDSTGHSEQNYTLPEEITRNISLGSFAYESHRKALSHHAPSQGTELPQSNGISLPYTSNSFTPLPSSSLYIINPVNKGYLVETDPRFANYRQWLGSDYMLDSLKLDPNNLHKRLGDGYYEQRLINEQIAELTGHRRLDGYQNDEEQFKALMDNGATAARSMNLSVGIALSAEQVAQLTSDIVWLVQKEVKLPDGGTQTVLVPQVYVRVKNGDIDGKGALLSGSNTQINVSGSLKNSGTIAGRNALIINTDTLDNIGGRIHAQKSAVTATQDINNIGGMLSAEQTLLLNAGNNINSQSTTASSQNTQGSSTYLDRMAGIYITGKEKGVLAAQAGKDINIIAGQISNQSEQGQTRLQAGRDINLDTVQTSKHQATHFDADNHVIRGSTNEVGSSIQTKGDVTLLSGNNLNAKAAEVSSANGTLAVSAKNDINISAGINTTHVDDASKHTGRSGGGNKLVITDKAQSHHETAQSSTFEGKQVVLQAGNDANILGSNVISDNGTQIQAGNHVRIGTTQTQSQSETYHQTQKSGLMSAGIGFTIGSKTNTQENQSQSNEHTGSTVGSLKGDTTIVAGKHYEQIGSTVSSPEGNNTIYAQSIDIQAAHNKLNSNTTQTYEQKGLTVAFSSPVTDLAQQAIAVAQSSKQVGQSKNDRVNAMAAANAGWQAYQTGKSAQNLANGTTNAKQVSISITYGEQQNRQTTQVQANQAQASQIQAGGKTTLIATGAAEQSNINIAGSDVAGKAGTILIADNDITLQSAEQSNTERGQNKSAGWNAGAAVSFGQGGWSLGVTAGGNVGKGYGNGDSITHRHSHIGDKGSQTLIQSGGDTTIKGAQVRGKGVQVNAKNLSIQSVQDRETYQSKQQNASAQVTVGYGFSAGGDYSQSKIRADHVSVTEQSGIYAGEDGYQIKVGNHTDLKGGIITSTQSAEDKGKNRFQTATLTHSDIKNHSQYKGESFGLGASASISGKTLGQGAQNKPQNKHLTSVADKNSASSSVGYGSDSDSQSSITKSGINTRNIQITDEAAQIRLTGKTAAQTKADIDTNVTTDTAERHSGSLKNTFNKEAVQSELDLQRTVSQDFSKNVQQANTEINQHLDKLKADKEAAETAAAEALANGDMETAKRKAHEAQDAAAKADNWQQGKVILNMLASGLAAPTQSGAGIAAATASPAVSYAIGQHFKDLAGQNANGKLTASQETAHVLAHAVLGAAVAAVGDNNALAGALSAGGSEAAAPYISKWLYGKEKGSDLTAEEKETVTAITNVLGTATGAAVGNSATDAAQGSLNAQSAVENNDTVEQVKFALRHPRIAIAIGSVHKDPGSTLEPNISTIASTFQLNLFPNSEFGGEGGVGNAFRHVLWQATITREFGKDIAVKVGNSHESGEKINYSIRRNLSLDKADEMIDQLNNEIGREIALNTNRLNTKELVGLILETYKNNGFYQAERNSNGNYDVVRKRLSEKDYQNTSNILIHLDNTGAGFKIQQRRKQIRAQISARQWRR

SEQ ID NO: 40502 - DNA, 7800 bp, Neisseria meningitidis
atgaaccgcaccctgtacaaagttgtatttaacaaacatcgaaactgcatgatagccgttgctgaaaatgccaaacgcgagggcaaaaacacagccgacacccaagctgtaggtattttgccaaatgatattgcgggctttgcgggttttatccattctatctctgttatctcattctccctttcattactgctcggttctgcccttatcctgacttcttcttctgctactgcccaaggtatcgttgccgacaaatccgcacctgcacagcaacagcctaccatcctgcaaacaggtaacggcataccgcaagtcaatattcaaacccctacttcggcaggggtttctgttaatcaatacgcccagtttgatgtgggtaatcgcggggcgattttaaacaacagtcgcagcaacacccaaacacagctaggcggttggattcaaggcaatccttggttggcaaggggcgaagcacgtgtggttgtaaaccaaatcaacagcagccattcttcacaactgaatggctatattgaagtgggcggacgacgtgcagaagtcgttattgccaatccggcagggattgcagtcaatggtggtggttttatcaatgcttcccgtgccactttgacgacagcccaaccgcaatatcaagcaggagaccttagcggctttaagataaggcaaggcaatgttgtaatcgccggacacggtttggatgcacgtgataccgattacacacgtattctcagttatcattccaaaattgatgcacccgtatggggacaagatgttcgtgtcgtcgcgggacaaaacgatgtggccgcaacaggtgatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggtcgagcaagcaggcattcgtaatcaagggcaatggtttgcctcagccggcaatgtggcagtgaatgctgagggtaaactggtcaacacgggcatgattgcagcgacgggagaaaatcatgcggtttcacttcatgcccgcaatgttcataatagcggtacggttgcctcacaggatgatgccaatattcacagccagacgctggacaattcaggtacggtcttatcctcaggtcgattgactgttcgtaatttaggccgtctgaaaaaccaaaacaacggtacgatccaggctgcccgcttagatatgtcaacaggtggtttggataacacaggtaatattactcaaacaggttcacaagcattggatttggtatctgccggcaaattcgataacagtggcaagattggtgtaagtgacgttccacagaccggtttgaatcccaatccatcagtcataccacagattccgagtactgcaacaggttcaggcagcagcactgtctcggtatctaagcctggttcaaacaatcccgtttcacctacagcacctgcaaaaaactacgccgtaggacgcattcaaacaacaggagcatttgacaatgcaggatcaattaatgcgggtgggcaaattgacattgccgcccaaaacggtttgggaaattcgggtagtctgaatgcggctaaactacgagtatcaggcgattcatttaacaatacggtaaaaggcaaactccaggcacacgatctggctgttaacactcaaactgctaaaaacagcggtcacttattaactcaaaccggcaagattgataaccgtgaactgcataatgccggagaaattgccgccaacaatctgacactcattcattcgggccgcttgagcaatgataaaaaaggcaatattcgagctgcacatttacagcttgataccgccggtttacataatgcaggtaacattcttgccgatagtggaaccgttaccaccaagaataatcttcgcaatacaggaaaagtttctgttgcacgactgaataccgaaggtcagactctagataatacgcgcggacgtatagaggctgaaacggttaacatccaaagtcagcaactgactaaccaaagcggccatattactgctaccgaacaactgactatcaatagtcgaaatgtagacaaccaaaacggcaaactcctatctgcaaaccaagcacaattagctgtttcagacggcctatacaaccaacatggtgaaattgccaccaaccggcagttgtctattcacgataaaaatcaaaacactttggcgttaaacaatgcggatggcacgattcaatctgccggtaatgtatcgctacaagccaaatcactcgccaacaatggcacattaacagccggtaacaaactggatattgctttgacggacgatttcgtcgtagagcgcgacctcactgcaggcaaacaattaaatctaagcataaaaggccgtctgaaaaatacccataccctacaagcaggccatacgctcaaactcaatgccggcaatatagataaccaagttacaggcaaaattattggtggagaacaaacggacatcacatccgaacagcatgttgacaacaggggcttgatcaacagcgacggtttgacccacatcggtgcaggtcaaaccctgaccaacaccgggacaggcaaaatctatggcaaccatattgccctggacgcgcaaatactgcttaaccgggaagaaacgacggaaggcagtaccaaagcgggggcaatagctgcaaggaaacgtttggatattggagcgaaagagattcataaccaagaaggtgccctactatccagcgaaggtatttttgccgtaggtaatcgactggatgaacaacatcatgcggcaggcatggccgatacctttgttaatggcagtgccggtttggaagtacaaggtgatgcattgatgtccgttcggaatatgcagaatatcaataatcactttaaaacagagacatacttagccaaagcggaaaagcaagtccgcgactacaccgtactggggcaaaatacctactatcaggcgggaaaagacggtttattcgacaactcgcaaggacaaaaagaccaaactactgctacgttccatttaaaaaatggttctcgtattgaggccaaccaatggcatgtccgagactaccacatcgagacttataaagaacgcatcatcgaaaaccggccggcacacattactgtgggcggtgatttgactgcctcaggtcaaaattggctgaacaaagacagccggattgtagtaggcgggcgtattatcactgatgatttaaaccagaaagaaattaccaatcaaagtacaacaggcaaaggtcgcacagatgctgtcggcacacagtgggattcagttacaaaaaaaggatggtacagcggtagaaaaagacaacgccgtactgaaagaaaccatactccttaccatgatacccaactatttacccacgacttcgacacgcctgtatccgtcatccaacagaatgccgcctccccttcctttcaacccgccgcatctgcaatcaaactgattgacggagtatccacggcagccgtcaatggtcagcgcatccataccggtaatgtggtctcgttaaataacgctactgttactctgcctaacagcagcctctataccacccatcctgacaataaaggctggttggttgaaaccgatcctcaatttgcagactaccgccgctggttgggcagcgactacatgttgcaacaactgcaattggacaccaatcatctacacaaacggcttggcgacggctactacgaacaaaaacttgttaatgaacaaatccatcagttaacaggctaccgccgactcgacggctacaggagtgatgaagaacaattcaaagctctgatggacaacggccttactgctgccaaaacattcggtctcaccccaggtatcgccttgagtgcagagcaagttgcccgcttaacttcagatatcgtttggatggaaaatcaaaccgtcaccctgtctgacggttcgactcaaaccgtactggttcctaaagtctatgccctggcgcgcaaaggtgatctcaatacctccggtggcctgattagtgccgaacaagtcttacttaaactgcaaaacggcaacctgactaacagcggtaccattgcggggcgacaggccgtactcatccaggcacggaatattaacagcaacggtaacattcaagccgaccaaatcggcttaaaagctgaaaaaagtatcaatatcgacggcgggcaggtacaagcaggcagactgctgactgcccaagcgcaaaatatcaaccttaacggtacaacccaaacttccggtaatgaacgtaacggcaataccgccatcgatcgtatggccggcattaacgtggtcggaagccatactgaacaagtagataacagaacttcagacggcatcctatccctgcatgccagcaacgatatcaacctcaatgcggccaccgtctctaaccaagttaaagacggcactacccaaattaccgccggcaataatctcaacctcggcaccatccgtaccgaacatcgcgaagcctatggtacattagatgacgagaaccatcgccatgtccgccaaagtaccgaagtcggcagcagtatccgcacgcaaaacggcgcactgcttagagccggtaacgacttaaaaatccgccaaggcgaactggaggccgaagaaggcaaaaccgtccttgccgcaggacgtgatgtcactatcagcgaaggacgccaaataaccgaactggatacctcggtaagcggaaaaagcaaaggcatcctttccagtaccaaaacacacgaccgctaccgcttcagtcatgatgaagcagtcggcagcaacatcggcggcggcaaaatgattgttgcagccgggcaggatatcaatgtacgcggcagcaaccttatttctgataagggcattgttttaaaagcaggacacgacatcgatatttctactgcccataatcgctataccggcaatgaataccacgagagcaaaaaatcaggcgtcatgggtactggcggattgggctttactatcggtaaccggaaaactaccgatgacactgatcgtaccaatattgtccatacaggcagcattataggcagcctgaatggagacaccgttacagttgcaggaaaccgctaccgacaaaccggcagtaccgtctccagccccgaggggcgcaataccgtcacagccaaaagcatagatgtagagttcgcaaacaaccggtatgccactgactacgcccatacccaggaacaaaaaggccttaccgtcgccctcaatgtcccggttgtccaagctgcacaaaacttcatacaagcagcccaaaatgtgggcaaaagtaaaaataaacgcgttaatgccatggctgcagccaatgctgcatggcagagttatcaagcaacccaacaaatgcaacaatttgctccaagcagcagtgcgggacaaggtcaaaacaacaatcaaagccccagtatcagtgtgtccattacctacggcgaacagaaaagtcgtaacgagcaaaaaagacattacaccgaagcggcagcaagtcaaattatcggcaaagggcaaaccacacttgcggcaacaggaagtggggagcagtccaatatcaatattacaggttccgatgtcatcggccatgcaggtactgccctcattgccgacaaccatatcagactccaatctgccaaacaggacggcagcgagcaaagcaaaaacaaaagcagtggttggaatgcaggcgtagccgtcaaaataggcaacggcatcaggtttggaattaccgccggaggaaatatcggtaaaggtaaagagcaagggggaagtactacccaccgccacacccatgtcggcagcacaaccggcaaaactaccatccgaagcggcggggataccaccctcaaaggtgtgcagctcatcggcaaaggcatacaggcagatacgcgcaacctgcatatagaaagtgttcaagatactgaaacctatcagagcaaacagcaaaacggcaatgtccaagttactgtcggttacggattcagtgcaagcggcagttaccgccaaagcaaagtcaaagcagaccatgcctccgtaaccgggcaaagcggtatttatgccggagaagacggctatcaaatcaaagtcagagacaacacagacctcaagggcggtatcatcacgtctagccaaagcgcagaagataagggcaaaaacctttttcagacggccacccttactgccagcgacattcaaaaccacagccgctacgaaggcagaagcttcggcataggcggcagtttcgacctgaacggcggctgggacggcacggttaccgacaaacaaggcaggcctaccgacaggataagcccggcagccggctacggcagcgacggagacagcaaaaacagcaccacccgcagcggcgtcaacacccacaacatacacatcaccgacgaagcgggacaacttgcccgaacaggcaggactgcaaaagaaaccgaagcgcgtatctacaccggcatcgacaccgaaactgcggatcaacactcaggccatctgaaaaacagcttcgacaaagacgcggtcgccaaagagatcaacctgcaaagggaagtaacgaaggagttcggcagaaacgccgcccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggcaggcggactgacgaccggcagcctcggcggcatactggccggcggcggcacttcccttgccgcaccgtatttggacaaagcggcggaaaacctcggtccggcgggcaaagcggcggtcaacgcactgggcggtgcggccatcggctatgcaactggtggtagtggtggtgctgtggtgggtgcgaatgtagattggaacaataggcagctgcatccgaaagaaatggcgttggccgacaaatatgccgaagccctcaagcgcgaagttgaaaaacgcgaaggcagaaaaatcagcagccaagaagcggcaatgagaatccgcaggcagatactgcgttgggtggacaaaggttcccaagacggctataccgaccaaagcgtcatatcccttatcggaatgaaaggcgaagacaaagccttgggttatacttgggactaccgcgactacggcgcaagaaatccgcaaacctacaacgatccgaagctgtttgaggaataccgccgacaggacaaacccgaataccgcaacctgacctggctgcacagcgggacgaaagacaccaaaatcaggcagggagagcggaaaaacgaagagtttgcactgaacgttgccgaaggactgacgagccttgtcaaccccaatccgaggataaaagtcccgattcttgcaggcatccgcaacctgaaaaacatcaagccgacagttaccggcagcgatcccttattggcgggtgcggggaatatccgtatccctgcaaacggcaatgttgcgaagggggacaggattccggatacggcattggctagcaagggaatcaaacataaagatcgtaaagatcaactggagaaaaaataa

SEQ ID NO: 40503 - protein, 2599 aa, Neisseria meningitidis
MNRTLYKVVFNKHRNCMIAVAENAKREGKNTADTQAVGILPNDIAGFAGFIHSISVISFSLSLLLGSALILTSSSATAQGIVADKSAPAQQQPTILQTGNGIPQVNIQTPTSAGVSVNQYAQFDVGNRGAILNNSRSNTQTQLGGWIQGNPWLARGEARVVVNQINSSHSSQLNGYIEVGGRRAEVVIANPAGIAVNGGGFINASRATLTTAQPQYQAGDLSGFKIRQGNVVIAGHGLDARDTDYTRILSYHSKIDAPVWGQDVRVVAGQNDVAATGDAHSPILNNAAANTSNNTANNGTHIPLFAIDTGKLGGMYANKITLISTVEQAGIRNQGQWFASAGNVAVNAEGKLVNTGMIAATGENHAVSLHARNVHNSGTVASQDDANIHSQTLDNSGTVLSSGRLTVRNLGRLKNQNNGTIQAARLDMSTGGLDNTGNITQTGSQALDLVSAGKFDNSGKIGVSDVPQTGLNPNPSVIPQIPSTATGSGSSTVSVSKPGSNNPVSPTAPAKNYAVGRIQTTGAFDNAGSINAGGQIDIAAQNGLGNSGSLNAAKLRVSGDSFNNTVKGKLQAHDLAVNTQTAKNSGHLLTQTGKIDNRELHNAGEIAANNLTLIHSGRLSNDKKGNIRAAHLQLDTAGLHNAGNILADSGTVTTKNNLRNTGKVSVARLNTEGQTLDNTRGRIEAETVNIQSQQLTNQSGHITATEQLTINSRNVDNQNGKLLSANQAQLAVSDGLYNQHGEIATNRQLSIHDKNQNTLALNNADGTIQSAGNVSLQAKSLANNGTLTAGNKLDIALTDDFVVERDLTAGKQLNLSIKGRLKNTHTLQAGHTLKLNAGNIDNQVTGKIIGGEQTDITSEQHVDNRGLINSDGLTHIGAGQTLTNTGTGKIYGNHIALDAQILLNREETTEGSTKAGAIAARKRLDIGAKEIHNQEGALLSSEGIFAVGNRLDEQHHAAGMADTFVNGSAGLEVQGDALMSVRNMQNINNHFKTETYLAKAEKQVRDYTVLGQNTYYQAGKDGLFDNSQGQKDQTTATFHLKNGSRIEANQWHVRDYHIETYKERIIENRPAHITVGGDLTASGQNWLNKDSRIVVGGRIITDDLNQKEITNQSTTGKGRTDAVGTQWDSVTKKGWYSGRKRQRRTERNHTPYHDTQLFTHDFDTPVSVIQQNAASPSFQPAASAIKLIDGVSTAAVNGQRIHTGNVVSLNNATVTLPNSSLYTTHPDNKGWLVETDPQFADYRRWLGSDYMLQQLQLDTNHLHKRLGDGYYEQKLVNEQIHQLTGYRRLDGYRSDEEQFKALMDNGLTAAKTFGLTPGIALSAEQVARLTSDIVWMENQTVTLSDGSTQTVLVPKVYALARKGDLNTSGGLISAEQVLLKLQNGNLTNSGTIAGRQAVLIQARNINSNGNIQADQIGLKAEKSINIDGGQVQAGRLLTAQAQNINLNGTTQTSGNERNGNTAIDRMAGINVVGSHTEQVDNRTSDGILSLHASNDINLNAATVSNQVKDGTTQITAGNNLNLGTIRTEHREAYGTLDDENHRHVRQSTEVGSSIRTQNGALLRAGNDLKIRQGELEAEEGKTVLAAGRDVTISEGRQITELDTSVSGKSKGILSSTKTHDRYRFSHDEAVGSNIGGGKMIVAAGQDINVRGSNLISDKGIVLKAGHDIDISTAHNRYTGNEYHESKKSGVMGTGGLGFTIGNRKTTDDTDRTNIVHTGSIIGSLNGDTVTVAGNRYRQTGSTVSSPEGRNTVTAKSIDVEFANNRYATDYAHTQEQKGLTVALNVPVVQAAQNFIQAAQNVGKSKNKRVNAMAAANAAWQSYQATQQMQQFAPSSSAGQGQNNNQSPSISVSITYGEQKSRNEQKRHYTEAAASQIIGKGQTTLAATGSGEQSNINITGSDVIGHAGTALIADNHIRLQSAKQDGSEQSKNKSSGWNAGVAVKIGNGIRFGITAGGNIGKGKEQGGSTTHRHTHVGSTTGKTTIRSGGDTTLKGVQLIGKGIQADTRNLHIESVQDTETYQSKQQNGNVQVTVGYGFSASGSYRQSKVKADHASVTGQSGIYAGEDGYQIKVRDNTDLKGGIITSSQSAEDKGKNLFQTATLTASDIQNHSRYEGRSFGIGGSFDLNGGWDGTVTDKQGRPTDRISPAAGYGSDGDSKNSTTRSGVNTHNIHITDEAGQLARTGRTAKETEARIYTGIDTETADQHSGHLKNSFDKDAVAKEINLQREVTKEFGRNAAQAVAAVADKLGNTQSYERYQEARTLLEAELQNTDSEAEKAAFRASLGQVNAYLAENQSRYDTWKEGGIGRSILHGAAGGLTTGSLGGILAGGGTSLAAPYLDKAAENLGPAGKAAVNALGGAAIGYATGGSGGAVVGANVDWNNRQLHPKEMALADKYAEALKREVEKREGRKISSQEAAMRIRRQILRWVDKGSQDGYTDQSVISLIGMKGEDKALGYTWDYRDYGARNPQTYNDPKLFEEYRRQDKPEYRNLTWLHSGTKDTKIRQGERKNEEFALNVAEGLTSLVNPNPRIKVPILAGIRNLKNIKPTVTGSDPLLAGAGNIRIPANGNVAKGDRIPDTALASKGIKHKDRKDQLEKK

SEQ ID NO: 40504 - DNA, 327 bp, Neisseria gonorrhoeae
atggacagcacattgtctaaaacgtgttgcgtttcgtgcatattgttgagcgtaaccaccaccattttcgcccgtcccagaccggcggcttccaatacttccctgcgtttcgcatcgccgaacgacaccggctcgcctgcacttctggctacctgcacgcgtgcgatgtccaagtcgagcgcgaaatacggaatatcctctttgggcgaagacgcgtccgaccgtctgcccgcccctgccgaagccgacaatcagcacatgatcagacttgctcatcgcttccaccaacatgctgtgcagatcgagcgacttcatgtcccagcttga

SEQ ID NO: 40505 - protein, 108 aa, Neisseria gonorrhoeae
MDSTLSKTCCVSCILLSVTTTIFARPRPAASNTSLRFASPNDTGSPALLATCTRAMSKSSAKYGISSLGEDASDRLPAPAEADNQHMIRLAHRFHQHAVQIERLHVPA

SEQ ID NO: 40506 - DNA, 630 bp, Neisseria meningitidis
atggacagcacattgtctaaaacgtgttgcgtttcgtgcatattgttgagcgtaaccaccaccattttcgcccgtcccagaccggcggcttccaatacttccctgcgtttcgcatcgccgaacgacaccggttcgcccgcacttctggcaacctgcacccgcgcaatgtccaagtcgagcgcgaaatacggaatatcctcttgggcaaggacgcgtccgaccgtctgcccgcccctgccgaagccgacaatcagcacatggtcggacttgctcatggtttctaccagcatactgtgcagatcgagcgacttcatgtcccagcttgacttgaccaaacgcccgaccagcgcatcgctgccgcccaagaggaagggcgcgataatcatcgacagcagaaccgccgccgtcgccgcctgttcccattctggcgaaaccatatcaagctgcccggcaatggccagcatcacgaagccgaactcgccgccctgcgcgagatacaaagccgttttgaggctgtcgccgaccgaatgtttcattttgaaggcaatggcaaacacaaccagtgccttcaacaccagcagcattgccaacagcatcaatacctgccgccagccgccgatcaatgcctga

SEQ ID NO: 40507 - protein, 209 aa, Neisseria meningitidis
MDSTLSKTCCVSCILLSVTTTIFARPRPAASNTSLRFASPNDTGSPALLATCTRAMSKSSAKYGISSWARTRPTVCPPLPKPTISTWSDLLMVSTSILCRSSDFMSQLDLTKRPTSASLPPKRKGAIIIDSRTAAVAACSHSGETISSCPAMASITKPNSPPCARYKAVLRLSPTECFILKAMANTTSAFNTSSIANSINTCRQPPINA

SEQ ID NO: 40508 - DNA, 630 bp, Neisseria meningitidis
atggacagcacattgtctaaaacgtgttgcgtttcgtgcatattgttgagcgtaaccaccaccattttcgcccgtcccagaccggcggcttccaatacttccctgcgtttcgcatcgccgaacgacaccggttcgcccgcacttctggcaacctgcacccgcgcaatgtccaagtcgagcgcgaaatacggaatatcctcttgggcaaggacgcgtccgaccgtctgcccgcccctgccgaagccgacaatcagcacatggtcggacttgctcatggtttctaccagcatactgtgcagatcgagcgacttcatgtcccagcttgacttgaccaaacgcccgaccagtgcatcgctgccgcccaagaggaagggcgcgataatcatcgacagcagaaccgccgccgtcgccgcctgttcccattctagcgaaaccatatcaagctgcccggcaatggccagcatcacgaagccgaactcgccgccctgcgcgagatacaaagccgttttgaggctgtcgccgaccgaatgtttcattttgaaggcaatggcaaacacaaccagtgccttcaacaccagcagcattgccaacagcatcaatacctgccgccagccgccgattaatgcctga

SEQ ID NO: 40509 - protein, 209 aa, Neisseria meningitidis
MDSTLSKTCCVSCILLSVTTTIFARPRPAASNTSLRFASPNDTGSPALLATCTRAMSKSSAKYGISSWARTRPTVCPPLPKPTISTWSDLLMVSTSILCRSSDFMSQLDLTKRPTSASLPPKRKGAIIIDSRTAAVAACSHSSETISSCPAMASITKPNSPPCARYKAVLRLSPTECFILKAMANTTSAFNTSSIANSINTCRQPPINA

SEQ ID NO: 40510 - DNA, 351 bp, Neisseria gonorrhoeae
atgccgtctgaacaatatcttttcagacggcattttgtatgggggttaacggttgttcagcccgagtacgtcctgcatatcgtacaaacccgttttgccgtttacccaaactgcggcgcggacggcaccggcggcaaaggtcatgcggctgccggctttgtgggtgatttccacgcgttcgccgtcggtggcgaagagggcggtgtggtcgccgactatgtcgcctgcgcggacggtggcaaagccgatggtggaaggatcgcgcggaccagtgtggccttcgcggccgtaaacggcgcattgtttgaggtcgcggccgagcgcgccggcgatgacttcgcccattcgtaa

SEQ ID NO: 40511 - protein, 116 aa, Neisseria gonorrhoeae
MPSEQYLFRRHFVWGLTVVQPEYVLHIVQTRFAVYPNCGADGTGGKGHAAAGFVGDFHAFAVGGEEGGVVADYVACADGGKADGGRIARTSVAFAAVNGALFEVAAERAGDDFAHS

SEQ ID NO: 40512 - DNA, 351 bp, Neisseria meningitidis
atgccgtctgaacaatatcttttcagacggcattttgtatgggggttaacggttgttcagcccgagtacgtcctgcatatcgtacaaacccgttttgccgttgacccaaactgcggcgcggacggcaccggcggcaaaggtcatgcggctgctggccttgtgggtgatttccacgcgctcgccgtcggtggcgaagagggcggtgtggtcgccgacgatgtcgcctgcgcggacggtggcaaagccgatggtcgacggatcgcgcggaccggtgtggccttcgcggccgtaaacggcgcattgtttgaggtctctgccgagcgcgccggcgatgacttcgcccatgcgtaa

SEQ ID NO: 40513 - protein, 116 aa, Neisseria meningitidis
MPSEQYLFRRHFVWGLTVVQPEYVLHIVQTRFAVDPNCGADGTGGKGHAAAGLVGDFHALAVGGEEGGVVADDVACADGGKADGRRIARTGVAFAAVNGALFEVSAERAGDDFAHA

SEQ ID NO: 40514 - DNA, 351 bp, Neisseria meningitidis
atgccgtctgaacaatatcttttcagacggcattttgtatgggggttaacggttgttcagcccgagtacgtcctgcatatcgtacaaacccgttttaccgtttacccaaactgcggcgcggacggcgccggcggcaaaggtcatgcggctgcttgccttgtgggtgatttccacgcgctcgccgtcggtggcgaagagggcggtgtggtcgccgacgatgtcgcccgcgcggacggtggcaaagccgatggtggacggatcgcgcgggccggtgtggccttcgcggccgtaaacggcgcattgtttgaggtctctgccgagcgcgccggcgatgacttcgcccatgcgtaa

SEQ ID NO: 40515 - protein, 116 aa, Neisseria meningitidis
MPSEQYLFRRHFVWGLTVVQPEYVLHIVQTRFTVYPNCGADGAGGKGHAAACLVGDFHALAVGGEEGGVVADDVARADGGKADGGRIARAGVAFAAVNGALFEVSAERAGDDFAHA

SEQ ID NO: 40516 - DNA, 642 bp, Neisseria gonorrhoeae
atgcgacgacgggcagcggcatcgacaaggcgggtttgcagtccggcgtttatcaggtcttattgggcgatgcggacgtgcagtcggcggcggtacgcagcaaagagggcggatacggcgtgttgggtgcgaacgcgcgcgcttgccggcgcggaaatcgagctggtgcaggaaatcgcccgggaagtgcgtttgaaaaacgcgctcaaggcagtggcggaagattacgactttatcctgatcgactgtccgccttcgctgacgctgttgacgcttaacggcttggtggcggcgggcggcgtgattgtgccgatgttgtgcgaatattacgcgctggaagggatttccgatttgattgcgaccgtgcgcaaaatccgtcaggcggtcaatcccgatttggacatcacgggcatcgtgcgtacgatgtacgacagccgcagcaggctggttgccgaagtcagcgaacagttgcgcagccatttcggggatttgctttttgaaaccgccatcccgcgcaatatccgccttgcggaagcgccgagccacggtatgccggtgatggcttacgacgcgcaggcaaagggtgccaaggcgtatcttgccttggcggacgaactggcggcgagggtgtcggggaaatag

SEQ ID NO: 40517 - protein, 213 aa, Neisseria gonorrhoeae
MRRRAAASTRRVCSPAFIRSYWAMRTCSRRRYAAKRADTACWVRTRALAGAEIELVQEIAREVRLKNALKAVAEDYDFILIDCPPSLTLLTLNGLVAAGGVIVPMLCEYYALEGISDLIATVRKIRQAVNPDLDITGIVRTMYDSRSRLVAEVSEQLRSHFGDLLFETAIPRNIRLAEAPSHGMPVMAYDAQAKGAKAYLALADELAARVSGK

SEQ ID NO: 40518 - DNA, 774 bp, Neisseria meningitidis
atgagtgcgaacatccttgccatcgccaatcagaagggcggtgtgggcaaaacgacgacgacggtaaatttggcggcttcgctggcatcgcgcggcaaacgcgtgctggtggtcgatttggatccgcagggcaatgcgacgacgggcagcggcatcgacaaggcgggtttgcagtccggcgtttatcaggtcttattgggcgatgcggacgtgcagtcggcggcggtacgcagcaaagagggcggatacgctgtgttgggtgcgaaccgcgcgctggccggcgcggaaatcgaactggtgcaggaaatcgcccgggaagtgcgtttgaaaaacgcgctcaaggcagtggaagaagattacgactttatcctgatcgactgcccgccttcgctgacgctgttgacgcttaacgggctggtggcggcgggcggcgtgattgtgccgatgttgtgcgaatattacgcgctggaagggatttccgatttgattgcgaccgtgcgcaaaatccgtcaggcggtcaatcccgatttggacatcacgggcatcgtgcgcacgatgtacgacagccgcagcaggctggttgccgaagtcagcgaacagttgcgcagccatttcggggatttgctttttgaaaccgtcatcccgcgcaatatccgccttgcggaagcgccgagccacggtatgccggtgatggcttacgacgcgcaggcaaagggtaccaaggcgtatcttgccttggcggacgagctggcggcgagggtgtcggggaaatag

SEQ ID NO: 40519 - protein, 257 aa, Neisseria meningitidis
MSANILAIANQKGGVGKTTTTVNLAASLASRGKRVLVVDLDPQGNATTGSGIDKAGLQSGVYQVLLGDADVQSAAVRSKEGGYAVLGANRALAGAEIELVQEIAREVRLKNALKAVEEDYDFILIDCPPSLTLLTLNGLVAAGGVIVPMLCEYYALEGISDLIATVRKIRQAVNPDLDITGIVRTMYDSRSRLVAEVSEQLRSHFGDLLFETVIPRNIRLAEAPSHGMPVMAYDAQAKGTKAYLALADELAARVSGK

SEQ ID NO: 40520 - DNA, 774 bp, Neisseria meningitidis
atgagtgcgaacatccttgccatcgccaatcagaagggcggtgtgggcaaaacgacgacgacggtaaatttggcggcttcgctggcatcgcgcggcaaacgcgtgctggtggtcgatttggatccgcagggcaatgcgacgacgggcagcggcatcgacaaggcgagtttgcagtccggcgtttatcaggtcttattgggcgatgcggacgtgaaatcggcggcggtacgcagcaaagagggcggatacggcgtgttgggtgcgaaccgcgcgctggccggcgcggaaatcgagctggtgcaggaaatcgcccgggaagtgcgtttgaaaaacgcgctcaaggcagtggcggaagattacgactttatcctgatcgactgcccgccttcgctgacgctgttgacgcttaacggcttggtggcggcaggcggcgtgattgtgccgatgttgtgcgaatattacgcgctggaagggatttccgatttgattgcgaccgtgcgcaaaatccgtcaggcggtcaatcccgatttggatatcacgggcatcgtgcgtacgatgtacgacagccgcagcaggctagttgccgaagtcagcgaacagttgcgcagccatttcggggatttgctgtttgaaaccgtcatcccgcgcaatatccgccttgcggaagcgccgagccacggtatgccggtgatggcttatgatgcgcaggcaaagggtgccaaggcgtatcttgccttggcggacgagctgatggcgagggtgtcggggaaatag

SEQ ID NO: 40521 - protein, 257 aa, Neisseria meningitidis
MSANILAIANQKGGVGKTTTTVNLAASLASRGKRVLVVDLDPQGNATTGSGIDKASLQSGVYQVLLGDADVKSAAVRSKEGGYGVLGANRALAGAEIELVQEIAREVRLKNALKAVAEDYDFILIDCPPSLTLLTLNGLVAAGGVIVPMLCEYYALEGISDLIATVRKIRQAVNPDLDITGIVRTMYDSRSRLVAEVSEQLRSHFGDLLFETVIPRNIRLAEAPSHGMPVMAYDAQAKGAKAYLALADELMARVSGK

SEQ ID NO: 40522 - DNA, 465 bp, Neisseria gonorrhoeae
atgctcagggtcagaccggtattatttgccgtcaaggcttccgcctcttcgataccttgcagaatctgccgattaaagcgttcgcggctgcccaatattttcaggcgcatattgttttcgtgcaggcggcgtacctgtttttgcaaagcctgtaaaaacagccccatcaggaacgaaacttcgtcttcggggcgacgccagttttcggttgaaaaggcaaacacggtcagatattgcacgcccagtttggcgcaatgcttcaccatattttccaacgcgtccaagccgcgtttgtgtcccattatacgcgggagaaaacgttttttcgcccaacggccgttgccgtccataattacggcgatgtgcctcgggatggcggtgtgttccaaaatggtctgcgtgctgctcttcatatctgcctttcgcggttcggcgttcaaatgccgtctgaacgccgcgccgtga

SEQ ID NO: 40523 - protein, 154 aa, Neisseria gonorrhoeae
MLRVRPVLFAVKASASSIPCRICRLKRSRLPNIFRRILFSCRRRTCFCKACKNSPIRNETSSSGRRQFSVEKANTVRYCTPSLAQCFTIFSNASKPRLCPIIRGRKRFFAQRPLPSIITAMCLGMAVCSKMVCVLLFISAFRGSAFKCRLNAAP

SEQ ID NO: 40524 - DNA, 774 bp, Neisseria meningitidis
atgctcagggtcaggccggtattgtttgccgtcaacgcttccgcctcttcgatgccttgcagaatctgccggttgaagcgttcgcggctgcccaatatcttcaggcgcatattgttttcgtgcaggcggcgtacctgtttttgcaaagcctgtaaaaacagccccatcaggaacgaaacttcgtcttcggggcggcgccagttttcggttgaaaaggcaaacacggtcagatattgcacacccagtttggcgcaatgcttcaccatattttccaatgcgtccaaaccgcgtttgtgtcccattatgcgcgggaggaaacgttttttcgcccaacggccgttgccgtccataatcacggcgatatgcttgggaatggcggtgtgttccaaaacggcctgcgtgctgcttttcatgtctgcctttcgcggttcggcattcaaatgccgtctgaacgccgaaccgtgcaggttaaattgccatcaaatcttcttctttggcagtcaggagtttgtcggcttcggtaatgtatttgtcggtcagtttttgaaccgcttcttcgccgcgacgtgcctcgtcttcggaaatttctttgtctttgaggagttttttgatgtggtcgttggcatcgcggcgcacgttgcggatagagacgcggccttcttccgcttcgccgcgtacgactttaatcaggtctttgcggcgttcctcggtcagcatgggcatcggcacgcggatcaggtcgccgacagctgccgggttcagtcccaagtttga

SEQ ID NO: 40525 - protein, 257 aa, Neisseria meningitidis
MLRVRPVLFAVNASASSMPCRICRLKRSRLPNIFRRILFSCRRRTCFCKACKNSPIRNETSSSGRRQFSVEKANTVRYCTPSLAQCFTIFSNASKPRLCPIMRGRKRFFAQRPLPSIITAICLGMAVCSKTACVLLFMSAFRGSAFKCRLNAEPCRLNCHQIFFFGSQEFVGFGNVFVGQFLNRFFAATCLVFGNFFVFEEFFDVVVGIAAHVADRDAAFFRFAAYDFNQVFAAFLGQHGHRHADQVADSCRVQSQV

SEQ ID NO: 40526 - DNA, 774 bp, Neisseria meningitidis
atgctcagggtcaggccggtattgtttgccgtcaaggcttccgcctcttcgatgcccttcaggatttgacggttgaagcgttcgcggctgcccagtattttcaggcgcatattgttttcgtgcaggcggcgtacctgtttttgcaaagcctgtaaaaacagccccatcaggaacgaaacttcgtcttcggggcggcgccagttttcggttgaaaaggcaaacacggtcagatattgcacacccagtttggcgcaatgcttcaccatattttccaatgcgtccaaaccgcgtttgtgtcccattatgcgcgggaggaaacgttttttcgcccaacggccgttgccgtccataatcacggcgatatgcttgggaatggcggtgtgttccaaaacggcctgcgtgctgcttttcatgtctgcctttcgcggttcggcattcaaatgccgtctgaacgccgaaccgtgcaggttaaattgccatcaaatcttcttctttggcagtcaggagtttgtcggcttcggtaatgtatttgtcggtcagtttttgaaccgcttcttcgccgcgacgtgcctcgtcttcggaaatttctttgtctttgaggagttttttgatgtggtcgttggcatcgcggcgcacgttgcggatggagacgcggccttcttccgcttcgccgcgtacgactttaatcaggtctttgcggcgttcctcggtcagcatgggcatcggcacgcggatcaggtcgccgacagctgccgggttcagtcccaagtttga

SEQ ID NO: 40527 - protein, 256 aa, Neisseria meningitidis
MLRVRPVLFAVKASASSMPFRIRLKRSRLPSIFRRILFSCRRRTCFCKACKNSPIRNETSSSGRRQFSVEKANTVRYCTPSLAQCFTIFSNASKPRLCPIMRGRKRFFAQRPLPSIITAICLGMAVCSKTACVLLFMSAFRGSAFKCRLNAEPCRLNCHQIFFFGSQEFVGFGNVFVGQFLNRFFAATCLVFGNFFVFEEFFDVVVGIAAHVADGDAAFFRFAAYDFNQVFAAFLGQHGHRHADQVADSCRVQSQV

SEQ ID NO: 40528 - DNA, 393 bp, Neisseria gonorrhoeae
atgctgaaacaacgggtaataaccgctatgtggctgctgccgctgatgctgggcatgctgttttacgcgccgcaatggctgtgggctgcattttgcgggctgattgccctgaccgccttgtgggagtatgcccgtatggccggtttgtgcaaaaccgaaaccaaccattacctcgccgcaaccttggttttcggcgtagttgcctatgcgggcggctggatgctgcctaatttggtttggtatgttgttttggcattttggctcgccgttatgcctttgtggttgagattcaaatggaggctcaacggcggttggcaggtttatgccgtcggctggcttttgctcatgccgttttggttcgcgctcgtatccctggcgcccgcatcccgatga

SEQ ID NO: 40529 - protein, 130 aa, Neisseria gonorrhoeae
MLKQRVITAMWLLPLMLGMLFYAPQWLWAAFCGLIALTALWEYARMAGLCKTETNHYLAATLVFGVVAYAGGWMLPNLVWYVVLAFWLAVMPLWLRFKWRLNGGWQVYAVGWLLLMPFWFALVSLAPASR

SEQ ID NO: 40530 - DNA, 798 bp, Neisseria meningitidis
atgctgaaacaacgggtaataaccgccatgtggctgctgccgctgatgctgggcatgctgttttacgcgccgcaatggttgtgggctgcattttgcggactgattgccctgattgccttgtgggaatatgcccgtatgggcggtttgtgcaaaattaaaaccaaccattacctcgccgcaaccttggttttcggcgtggttgcctatgcgggcggctggatgctgcctaatttggtttggtatgttgttttggcattttggctcgccgttatgcctttatggttgagattcaaatggaggctcaacggcggttggcaggtttatgccgtcggctggcttctggtcatgccgttttggttcgcgctcgtatccctgcgcccgcatcccgatgatgccctgccgctgctcgccgtgatgggtttggtgtgggttgccgatatttgcgcgtatttcagcggcaaggcgttcggcaaacacaaaatcgcgccggcaatcagccccggcaaaagctgggaaggtgcaatcggcggcgcggtttgcgtggcagtgtacatgaccgccgtacgaagtgccggctggctggcattcgatacaggctggttcgataccgtgttaatcggtttggtgctgaccgttgtcagcgtatgcggcgaccttttggaaagctggctcaagcgcgcggcaggcatcaaagacagcagcaagctgctgcccggacacggcggcgtgttcgaccgtaccgacagcctgattgccgttatcagcgtctatgcagcgatgatgtcggttttaaattga

SEQ ID NO: 40531 - protein, 265 aa, Neisseria meningitidis
MLKQRVITAMWLLPLMLGMLFYAPQWLWAAFCGLIALIALWEYARMGGLCKIKTNHYLAATLVFGVVAYAGGWMLPNLVWYVVLAFWLAVMPLWLRFKWRLNGGWQVYAVGWLLVMPFWFALVSLRPHPDDALPLLAVMGLVWVADICAYFSGKAFGKHKIAPAISPGKSWEGAIGGAVCVAVYMTAVRSAGWLAFDTGWFDTVLIGLVLTVVSVCGDLLESWLKRAAGIKDSSKLLPGHGGVFDRTDSLIAVISVYAAMMSVLN

SEQ ID NO: 40532 - DNA, 798 bp, Neisseria meningitidis
atgctgaaacaacgggtgataaccgccatgtggctgctgccgctgatgctgggcatgctgttttacgcgccgcaatggttgtgggctgcattttgcggactgattgccctgattgccttgtgggaatatgcccgtatgggcggtttgtgcaaaattaaaaccaaccattacctcgccgcaaccttggttttcggcgtggttgcctatgcgggcggctggatgctgcctaatttggtttggtatgttgttttggcattttggctcgccgttatgcctttatggttgagattcaaatggaggctcaacggcggttggcaggtttatgccgtcggctggcttctggtcatgccgttttggttcgcgctcgtatccctgcgcccgcatcccgatgatgccctgccgctgctcgccgtgatgggtttggtgtgggttgccgatatttgcgcgtatttcagcggcaaggcgttcggcaaacacaaaatcgcaccggcaatcagccccggcaaaagctgggaaggtgcaatcggcggcgcggtttgcgtggccgtgtacatgaccgccgtacgaagtgccggctggctggcattcgatacaggctggttcgataccgtgttaatcggtttggtgttgaccgttgtcagcgtatgcggcgaccttttggaaagctggctcaagcgcgcggcaggcatcaaagacagcagcaacctgctgcccggacacggcggcgtgttcgaccgcaccgacagcctgattgccgttatcagcgtctatgcagcgatgatgtcggttttaaattga

SEQ ID NO: 40533 - protein, 265 aa, Neisseria meningitidis
MLKQRVITAMWLLPLMLGMLFYAPQWLWAAFCGLIALIALWEYARMGGLCKIKTNHYLAATLVFGVVAYAGGWMLPNLVWYVVLAFWLAVMPLWLRFKWRLNGGWQVYAVGWLLVMPFWFALVSLRPHPDDALPLLAVMGLVWVADICAYFSGKAFGKHKIAPAISPGKSWEGAIGGAVCVAVYMTAVRSAGWLAFDTGWFDTVLIGLVLTVVSVCGDLLESWLKRAAGIKDSSNLLPGHGGVFDRTDSLIAVISVYAAMMSVLN

SEQ ID NO: 40534 - DNA, 501 bp, Neisseria gonorrhoeae
atgatccgtttgacccgcgcgtttgccgccgccctgatcggtttatgctgcaccacaggcgcgcacgccgacaccttccaaaaaatcggctttatcaacaccgagcgcatctacctcgaatccaagcaggcgcgcaacatccaaaaaacgctggacggcgaattttccgcccgtcaggacgaattgcaaaaactgcaacgcgaaggcttggatttggaaaggcagctcgccggcggcaaacttaaggacgcaaaaaaggcgcaagccgaagaaaaatggcgcgggctggtcgaagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcaggacgtgatttacgtcaacacccaatacgacgttaccgacagcgtcattaaagaaatgaacgcccgctga

SEQ ID NO: 40535 - protein, 166 aa, Neisseria gonorrhoeae
MIRLTRAFAAALIGLCCTTGAHADTFQKIGFINTERIYLESKQARNIQKTLDGEFSARQDELQKLQREGLDLERQLAGGKLKDAKKAQAEEKWRGLVEAFRKKQAQFEEDYNLRRNEEFASLQQNANRVIVKIAKQEGYDVILQDVIYVNTQYDVTDSVIKEMNAR

SEQ ID NO: 40536 - DNA, 501 bp, Neisseria meningitidis
atgacccgtttgacccgcgcgtttgccgcggctctgatcggtttgtgctgcaccgcaggcgcgcacgccgacaccttccaaaaaatcggctttatcaacaccgagcgcatctacctcgaatccaagcaggcgcgcaagattcaaaaaacgctggacagcgaattttccgctcgtcaggacgaattgcaaaaactgcaacgcgaaggtctggatttggaaaggcagcttgccgaaggcaaactcagaaacgcaaaaaaggcgcaagccgaagaaaaatggcgcgggctggtcgcagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcagaacgtgatttacgtcaacacccaatacgacgttaccgacagcgtcattaaagaaatgaacgcccgctga

SEQ ID NO: 40537 - protein, 166 aa, Neisseria meningitidis
MTRLTRAFAAALIGLCCTAGAHADTFQKIGFINTERIYLESKQARKIQKTLDSEFSARQDELQKLQREGLDLERQLAEGKLRNAKKAQAEEKWRGLVAAFRKKQAQFEEDYNLRRNEEFASLQQNANRVIVKIAKQEGYDVILQNVIYVNTQYDVTDSVIKEMNAR

SEQ ID NO: 40538 - DNA, 501 bp, Neisseria meningitidis
atgacccgtttgacccgcgcgtttgccgcggctctgatcggtttgtgctgcaccgcaggcgcgcacgccgacaccttccaaaaaatcggctttatcaacaccgagcgcatctacctcgaatccaagcaggcgcgcaagattcaaaaaacgctggacagcgaattttccgcccgccaggacgaattgcaaaaactgcaacgcgaaggtctggatttggaaaggcagcttgccgaaggcaaactcaaagacgcaaaaaaggcgcaagccgaagaaaaatggtgcgggctggtcgcagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcaggacgtgatttacgtcaacacccaatacgacgttaccgacagcgtcattaaagaaatgaacgcccgctga

SEQ ID NO: 40539 - protein, 166 aa, Neisseria meningitidis
MTRLTRAFAAALIGLCCTAGAHADTFQKIGFINTERIYLESKQARKIQKTLDSEFSARQDELQKLQREGLDLERQLAEGKLKDAKKAQAEEKWCGLVAAFRKKQAQFEEDYNLRRNEEFASLQQNANRVIVKIAKQEGYDVILQDVIYVNTQYDVTDSVIKEMNAR

SEQ ID NO: 40540 - DNA, 357 bp, Neisseria gonorrhoeae
atgcgcgttttccgagtaaaccgatttgttgttaccgttttcggcggcggtataggttctgccgtcccacacgctgcctgcgtcggcaaacaggctcaggcggacggtgcgtgcgtctttcgcaccgggcatcgggaagagcagctcggcggagacgttggcttttttgttgccgccgtagctgattttttcgccgtattcgtcatacactttcgggccgagcgtgccgctttcgtagccgcgcaccgaacccaggccgccgccgtagaagttttcaaagaaggggatttctttggttctgccgtagccgcccgcaatgccgacttcgccgccgagcatcagcgtgaaggttttgct

SEQ ID NO: 40541 - protein, 119 aa, Neisseria gonorrhoeae
MRVFRVNRFVVTVFGGGIGSAVPHAACVGKQAQADGACVFRTGHREEQLGGDVGFFVAAVADFFAVFVIHFRAERAAFVAAHRTQAAAVEVFKEGDFFGSAVAARNADFAAEHQREGFA

SEQ ID NO: 40542 - DNA, 483 bp, Neisseria meningitidis
atgggtattgccggcgccgtaaatgttttgaaccctgccgccggtcgcggaactgctgttgtcgtcgtaggttttgccgtcccacacgctgcctgcgtcggcaaacaggctcaggcggacggtgcgcgcgtctttcgcgccgggcatcgggaagagcagctcggcggagacgttggcttttttgttgccgccgtagctgattttttcgccgtattcgtcatagactttcggaccgagcgtgccgctttcgtatccgcgcaccgaacccaggccgccgccgtagaagttttcaaagaaggggatttctttggttctgccgtagccgcccgcaatgccgacttcgccgccgagcatcagcgtgaaggttttgctcagggggaagaaccaggtttggttgtgggtggcggagtagtattgcagtttgctgccaggcagggcgatttcggcgttcacgcccgtcaggtagccgcgcgtcggccataa

SEQ ID NO: 40543 - protein, 160 aa, Neisseria meningitidis
MGIAGAVNVLNPAAGRGTAVVVVGFAVPHAACVGKQAQADGARVFRAGHREEQLGGDVGFFVAAVADFFAVFVIDFRTERAAFVSAHRTQAAAVEVFKEGDFFGSAVAARNADFAAEHQREGFAQGEEPGLVVGGGVVLQFAARQGDFGVHARQVAARRP

SEQ ID NO: 40544 - DNA, 483 bp, Neisseria meningitidis
atgggtattgccggcgccgtaaatgttttgaaccctgccgccggtcgcggaactgctgttgtcgtcgtaggttttgccgtcccacacgctgcctgcgtcggcaaacaggctcaggcggacggtgcgcgcgtctttcgcgccgggcatcgggaagagcagctcggcggagacgttggcttttttgttgccgccgtagctgattttttcgccgtattcgtcatacactttcggaccgagcgtgccgctttcgtatccgcgcaccgaacccaggccgccgccgtagaagttttcaaagaaggggatttctttggttctgccgtagccgcccgcaatgccgacttcgccgccgagcatcagcgtgaaggttttgcttaaggggaagaaccaggtttggttgtgggtggcggagtagtattgcagtttgctgccgggcagggcgatttcggcgttcacgcccgtcaggtagccgcgcgtcggccataa

SEQ ID NO: 40545 - protein, 159 aa, Neisseria meningitidis
MGIAGAVNVLNPAAGRGTAVVVVGFAVPHAACVGKQAQADGARVFRAGHREEQLGGDVGFFVAAVADFFAVFVIHFRTERAAFVSAHRTQAAAVEVFKEGDFFGSAVAARNADFAAEHQREGFAGEEPGLVVGGGVVLQFAAGQGDFGVHARQVAARRP

SEQ ID NO: 40546 - DNA, 888 bp, Neisseria gonorrhoeae
atgtgcgccatcgtcggggcggcggggctgccttccgcgctcgcagcggcgcaaaaaggcaaaaccatttatctggcaaacaaagaaacgctggtggtttccggcgcgttgtttatggaaaccgcccgcgcaaacggcgcggcagtgttgcccgtcgacagcgaacacaacgccattttccaagttttgccgcgcgattacacagaccgtctgaacgaacacggcatcgattcgattatcctgaccgcttccggcggcccgtttttaacaaccgatttaagcacgttcgacagcattacgcccgagcaggcggtcaaacaccccaattggcgtatggggcgcaaaatctccgtcgattcagccactatggcaaacaagggcttggaactgattgaagcgcattggctgttcaactgtccgcccgacaaactcgaagtcgtcatccatccccaatccgtgatacacagtatggtgcgctaccgcgacggctccgtgctggcgcaactgggcaatcccgatatgcgaacgcccatcgcctattgtttgggcttgcccgagcgcatcgattcgggtgtcggcaaactcgatttcggcgcattgtccgcgctgaccttccaaaagcccgacttcggccgcttcccctgcctgaagttcgcctatgaaaccataaacgcaggcggagccgcgccctgcgtattgaacgccgccaacgaaaccgccgtcgccgcctttttggacggacagattaagtttaccgacattgccaaaaccgtcgcccactgtcttgcacaagacttttcaaacggcatgggcgatatagaaggactgttggcgcaagatgcccggacacgcgcacaagcgcgggcatttatcggcacactgcgctga

SEQ ID NO: 40547 - protein, 250 aa, Neisseria gonorrhoeae
MCAIVGAAGLPSALAAAQKGKTIYLANKETLVVSGALFMETARANGAAVLPVDSEHNAIFQVLPRDYTDRLNEHGIDSIILTASGGPFLTTDLSTFDSITPEQAVKHPNWRMGRKISVDSATMANKGLELIEAHWLFNCPPDKLEVVIHPQSVIHSMVRYRDGSVLAQLGNPDMRTPIAYCLGLPERIDSGVGKLDFGALSALTFQKPDFGRFPCLKFAYETINAGGAAPCVLNAANETAVAAFLDGQIK

SEQ ID NO: 40548 - DNA, 888 bp, Neisseria meningitidis
atgtgcgccatcgtcggggcggtggggctgccttccgcgctcgcagcggcgcaaaaaggcaaaaccatttatctggcaaacaaagaaacgctggtggtttccggcgcgttgtttatggaaaccgcccgtgcaaacggcgcggcagtgctgcccgtcgacagcgaacacaacgccgttttccaagttttgccgcgcgattacgccggccgtctgaacgaacacggcatcgcttcgattatcctgaccgcttccggcggcccgtttctgaccgccgatttaaacacgttcgaccgcattacgcccgcccaagcggtcaaacaccccaattggcgtatgggacgcaaaatctccgtcgattccgccaccatgatgaacaaaggtttggagctgattgaagcgcattggctgttcaactgtccgcccgacaaactcgaagtcgtcatccatccgcaatccgtgatacacagcatggtgcgctaccgcgacggctccgtgctggcgcaactgggcaatcccgatatgcgaacgcccatcgcttattgtttgggtttgcccgagcgcatcgattcgggtgtcggcgacctggatttcgacgcattgtccgcgctgaccttccaaaagcccgactttgaccgcttcccctgcctgaggctcgcctatgaagccatgaacgcaggcggagccgcgccctgcgtattgaacgccgccaacgaagccgccgtcgccgcctttttggacggacagattaagtttaccgacattgccaaaaccgtcgcccactgtcttgcacaagacttttcagacggcataggcgatataggggggctcttggcgcaagatgcccggacacgcgcacaagcgcgagcatttatcggcacactgcgctga

SEQ ID NO: 40549 - protein, 295 aa, Neisseria meningitidis
MCAIVGAVGLPSALAAAQKGKTIYLANKETLVVSGALFMETARANGAAVLPVDSEHNAVFQVLPRDYAGRLNEHGIASIILTASGGPFLTADLNTFDRITPAQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLRLAYEAMNAGGAAPCVLNAANEAAVAAFLDGQIKFTDIAKTVAHCLAQDFSDGIGDIGGLLAQDARTRAQARAFIGTLR

SEQ ID NO: 40550 - DNA, 888 bp, Neisseria meningitidis
atgtgcgccatcgtcggggcggtggggctgccttccgcgctcgcagcggcgcaaaaaggcaaaaccatttatctggcgaacaaagagacgctggtggtttccggcgcgttgtttatggaaaccgcccgtgcaaacggcgcggcagtgctgcccgtcgacagcgaacacaacgccgttttccaagttttgccgcgcgattacacaggtcgcctgaacgaacacggcatcgcttcgattatcctgaccgcttccggcggcccgtttctgaccgccgatttaaacacgttcgacagcattacgcccgaccaagcggtcaaacaccccaattggcgtatgggacgcaaaatctccgtcgattccgccaccatgatgaacaaaggtttggagctgattgaagcgcattggctgttcaactgtccgcccgacaaactcgaagtcgtcatccatccgcaatctgtgatacacagcatggtgcgctaccgcgacggctccgtgttggcgcaactgggcaatcccgatatgcgaacgcctatcgcttattgtttgggtttgcccgagcgcatcgattcgggtgtcggcgacctggatttcgacgcattgtccgcgctgaccttccaaaagcccgactttgaccgcttcccctgcctgaagctcgcctatgaagccatgaacgcaggcggagccgcgccctgcgtattgaacgccgccaacgaagccgccgtcgccgcctttttggacggacagattaagtttaccgacattgccaaaaccgtcgcccattgtctttcacaagacttttcagacggcataggcgacataggggggctcttggcgcaagatgcccggacacgcgcacaagcgcgggcatttatcggcacactgcgctga

SEQ ID NO: 40551 - protein, 295 aa, Neisseria meningitidis
MCAIVGAVGLPSALAAAQKGKTIYLANKETLVVSGALFMETARANGAAVLPVDSEHNAVFQVLPRDYTGRLNEHGIASIILTASGGPFLTADLNTFDSITPDQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLKLAYEAMNAGGAAPCVLNAANEAAVAAFLDGQIKFTDIAKTVAHCLSQDFSDGIGDIGGLLAQDARTRAQARAFIGTLR

SEQ ID NO: 40552 - DNA, 1095 bp, Neisseria gonorrhoeae
atgccctgtttgtgccgccttaatcgcaatatcggcagtttccaaatcacgaatctcaccgaccataatgatgtccgggtcctgacgcaggaaagacttcaaagcagcggcaaaagtcagaccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtaaggacggtgaatcgcttccaacaacaattttttctggaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctaccgtcctgcggtatccgtttttcggaaatgtccaaacgcgacattaccttaatccgggaagcaagctgcccccttaccgcaatgggcggctgaaccacctcgcggagctgcccgtccacacggaaacggatacgcgcattgtgttcgtaaaactcgaaatggatgtcggatgccccgctacgcaaggcatccgacaaagttttatggataaacctcggaacagggccgtcttctgcctcctcgtcgtcgatatacagggtgtggctttcctcttcctcttgcccctccccaagctcctgaagcagcgatgtcgaacgcgaacccacccaatcgagcaaacccgccaactggtcatcctcgacaatgaccaactcaaccgcaatccctgcggcagaaaccgttttctgaatttgcggcatctgggtcggatcggaaaccgcaaaaaatactttgtcgcccccacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctga

SEQ ID NO: 40553 - protein, 364 aa, Neisseria gonorrhoeae
MPCLCRLNRNIGSFQITNLTDHNDVRVLTQERLQSSGKSQTLLIIDVNLIDARQVNLGRVFRRCNIYRLRIQNIQTGIERHRLTRTRRTGYQHHPVRTVNRFQQQFFLERLKTELVDVQRRGIGIQNPHHDLFAKQRRQCADTEIDRLAALLKGQLHPTVLRYPFFGNVQTRHYLNPGSKLPPYRNGRLNHLAELPVHTETDTRIVFVKLEMDVGCPATQGIRQSFMDKPRNRAVFCLLVVDIQGVAFLFLLPLPKLLKQRCRTRTHPIEQTRQLVILDNDQLNRNPCGRNRFLNLRHLGRIGNRKKYFVAPTENRHTVELHHLLLRQHPHQHPVARIMTQIKNRITEHPRNQCRKRLGRNDTV

SEQ ID NO: 40554 - DNA, 1094 bp, Neisseria meningitidis
atgccctgtttgtgccgccttaatcgcaatatcggcagtttccaaatcacgaatctcaccgaccataatgatgtccgggtcctgacgcaggaaagacttcaaagcagcggcaaaagtcaggccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtagggacggtgaatcgctaccaacacawttttttctgaaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctgccgtcctgcggtatccgtttttcggaaatgtccaaacgcgacattaccttaatccgtgaagcaagctgcccccttaccgcaatgggcggctgaaccacctcgcggagctgcccgtccacacggaaacggatacgggcattgtgttcgtaaaactcgaaatggatgtccgatgccccgctgcgcaaggcatccgacaaagtcttatggataaacctcggaacagggccgtcttctgcctcctcgttgtcgatatacagggtgtggctttcctcttcctcctgcccctccccaagctcctgaagcagcgatgtcgaacgcgaacccacccaatcgagcaaacccgccaactggtcatcctcgacaatgaccaactcaacctcaatccctgcggcagaaacggttttctgaatttgcggcatctgtgtcggatcggaaaccgcaaaaaatactttgtcgccccgacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctga

SEQ ID NO: 40555 - protein, 363 aa, Neisseria meningitidis
  misc_feature (105)..(105): Xaa can be any naturally occurring amino acid
MPCLCRLNRNIGSFQITNLTDHNDVRVLTQERLQSSGKSQALLIIDVNLIDARQVNLGRVFRRCNIYRLRIQNIQTGIERHRLTRTRRTGYQHHPVGTVNRYQHXFFLKRLKTELVDVQRRGIGIQNPHHDLFAKQRRQCADTEIDRLAALLKGQLHPAVLRYPFFGNVQTRHYLNPSKLPPYRNGRLNHLAELPVHTETDTGIVFVKLEMDVRCPAAQGIRQSLMDKPRNRAVFCLLVVDIQGVAFLFLLPLPKLLKQRCRTRTHPIEQTRQLVILDNDQLNLNPCGRNGFLNLRHLCRIGNRKKYFVAPTENRHTVELHHLLLRQHPHQHPVARIMTQIKNRITEHPRNQCRKRLGRNDTV

SEQ ID NO: 40556 - DNA, 1095 bp, Neisseria meningitidis
atgccctgtttgtgccgccttaatcgcaatatcggcagtttccaaatcacgaatctcaccgaccataatgatgtccgggtcctgacgcaggaaagacttcaaagcagcggcaaaagtcagaccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtagggacggtgaatcgcttccaacaacaattttttctgaaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctgccgtcctgcggtatccgtttttcggaaatgtccaaacgcgacattaccttaatccgggaagcaagctgcccccttaccgcaatgggcggctgaaccacctcgcggagctgcccgtccacacggaaacggatacgggcattgtgttcgtaaaactcgaaatggatgtccgatgccccgctgcgcaaggcatccgacaaagtcttatggataaacctcggaacagggccgtcttctgcctcctcgttgtcgatatacagggtgtggctttcctcttcctcctgcccctccccaagctcctgaagcagcgatgtcgaacgcgaacccacccaatcgagcaaacccgccaactggtcatcctcgacaatgaccaactcaacctcaatccctgcggcagaaacggttttctgaatttgcggcatctgtgtcggatcggaaaccgcaaaaaatactttgtcgccccgacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctga

SEQ ID NO: 40557 - protein, 364 aa, Neisseria meningitidis
MPCLCRLNRNIGSFQITNLTDHNDVRVLTQERLQSSGKSQTLLIIDVNLIDARQVNLGRVFRRCNIYRLRIQNIQTGIERHRLTRTRRTGYQHHPVGTVNRFQQQFFLKRLKTELVDVQRRGIGIQNPHHDLFAKQRRQCADTEIDRLAALLKGQLHPAVLRYPFFGNVQTRHYLNPGSKLPPYRNGRLNHLAELPVHTETDTGIVFVKLEMDVRCPAAQGIRQSLMDKPRNRAVFCLLVVDIQGVAFLFLLPLPKLLKQRCRTRTHPIEQTRQLVILDNDQLNLNPCGRNGFLNLRHLCRIGNRKKYFVAPTENRHTVELHHLLLRQHPHQHPVARIMTQIKNRITEHPRNQCRKRLGRNDTV

SEQ ID NO: 40558 - DNA, 1209 bp, Neisseria gonorrhoeae
atgctgccgaatctgccaaacagccttaagaaagccgatatggacaacgaattgtggattatcctgctgccgattatccttttgcccgtcttcttcacgatgggctggtttgccgcccgcgtggatatgaaaaccgtattgaagcaggcaaaaagcatcccttcgggattttataaaagcctggacgctttggtcgaccgcaacagcgggcgcgcggcaagggagttggcggaagtcgtcgacggccggccgcaatcgtatgatttgaaccttaccctcggcaaactttaccgtcagcgcggcgaaaacgacaaagccatcaacatacaccggacaatgctcgattctcccgatacggtcggcgaaaagcgcgcgcgcgtcctgtttgaattggcgcaaaactaccaaagcgcgggtttggtcgatcgtgccgaacagatttttttggggctgcaagacggtgaaatggcgcgtgaagccagacagcacctgctcaatatctaccagcaggacagggattgggaaaaagcggttgaaaccgcccaacttcttagtcacgacgaacagacatatcagtttgagattgcacagttttattgcgaacttgcccaagccgcgctgttcaagtccaatttcgatgccgcgcgtttcaatgtcggcaaggcactcgaagccaacaaaaaatgcacccgcgccaacatgattttgggcgacattgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagggcgagaaagaagccgcgcaaaccgccgtcgagcttgtccgccgcaagcccgaccttaacggcgtgtaccgcctgctcggtttgaaactcagcgatttggatccggcttggaaagccgatgccgacatgatgcgttcggttatcggacggcagctccagcgcagcgtgatgtaccgttgccgcaactgccacttcaaatcccaagtctttttctggcactgtcccgcctgcaacaaatggcagacgtttacgccgaataaaatcgaagtttaa

SEQ ID NO: 40559 - protein, 402 aa, Neisseria gonorrhoeae
MLPNLPNSLKKADMDNELWIILLPIILLPVFFTMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGEMAREARQHLLNIYQQDRDWEKAVETAQLLSHDEQTYQFEIAQFYCELAQAALFKSNFDAARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKGEKEAAQTAVELVRRKPDLNGVYRLLGLKLSDLDPAWKADADMMRSVIGRQLQRSVMYRCRNCHFKSQVFFWHCPACNKWQTFTPNKIEV

SEQ ID NO: 40560 - DNA, 1209 bp, Neisseria meningitidis
atgcgcccgaatctaccaaacagccttaagaaagccgatatggacaacgaattgtggattatcctgctgccgattatccttttgcccgtcttcttcgcgatgggctggtttgccgcccgcgtggatatgaaaaccgtattgaagcaggcaaaaagcatcccttcgggattttataaaagcttggacgctttggtcgaccgcaacagcgggcgcgcggcaagggagttggcggaagtcgtcgacggccggccgcaatcgtatgatttgaacctcaccctcggcaaactttaccgccagcgtggcgaaaacgacaaagccatcaacatacaccggacaatgctcgattctcccgatacggtcggcgaaaagcgcgcgcgcgtcctgtttgaattggcgcaaaactaccaaagtgcggggttggtcgatcgtgccgaacagatttttttggggctgcaagacggtaaaatggcgcgtgaagccagacagcacctgctcaatatctaccaacaggacagggattgggaaaaagcggttgaaaccgcccggctgctcagccatgacgatcagacctatcagtttgaaatcgcccagttttattgcgaacttgcccaagccgcgctgttcaagtccaatttcgatgtcgcgcgtttcaatgtcggcaaggcactcgaagccaacaaaaaatgcacccgcgccaacatgattttgggcgacatcgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagtgcgagaaagaagccgcgcaaaccgccgtcgagcttgtccgccgcaagcccgaccttaacggcgtgtaccgcctgctcggtttgaaactcagcgatatgaatccggcttggaaagccgatgccgacatgatgcgttcggttatcggacggcagctacagcgcagcgtgatgtaccgttgccgcaactgccacttcaaatcccaagtctttttctggcactgccccgcctgcaacaaatggcagacgtttaccccgaataaaatcgaagtttaa

SEQ ID NO: 40561 - protein, 402 aa, Neisseria meningitidis
MRPNLPNSLKKADMDNELWIILLPIILLPVFFAMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGKMAREARQHLLNIYQQDRDWEKAVETARLLSHDDQTYQFEIAQFYCELAQAALFKSNFDVARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKCEKEAAQTAVELVRRKPDLNGVYRLLGLKLSDMNPAWKADADMMRSVIGRQLQRSVMYRCRNCHFKSQVFFWHCPACNKWQTFTPNKIEV

SEQ ID NO: 40562 - DNA, 1209 bp, Neisseria meningitidis
atgcgcccgaatctgccaaacagccttgagaaagccgatatggacaatgaattgtggattatcctgctgccgattatccttttgcccgttttcttcgcgatgggctggtttgccgcccgcgtggatatgaagactgtattaaagcaggcaaaaagcataccgtcgggattttataaaagtctggatgccttggttgaccgcaacagcgggcgcgcggcaagggagttggcggaagtcgtcgacggccggccgcaatcgtatgatttgaacctcaccctcggcaaactttaccgccagcgtggcgaaaacgacaaagccatcaatatgcaccaaacattgcttgactctcccgatacaaccggagccaagcgcgcgcgcgtcctgtttgaattggcgcaaaactaccaaagtgcggggttggtcgatcgtgccgaacagatttttttggggctgcaagacggtgaaatggcgcgtgaagccagacagcacctgctcaatatctaccaacaggacagggattgggaaaaagcggttgaaaccgcccggctgctcagccatgacgatcagacctatcagtttgaaatcgcccagttttattgcgaacttgcccaagccgcgctgttcaagtccaatttcgatgccgcgcgtttcaatgtcggcaaggcactcgaagccaacaaaaaatgcacccgcgccaacatgattttgggcgacatcgaacaccgacaaggcaatttccctgccgccgtcgaagcctatgccgccatcgagcagcaaaaccatgcatacttgagtatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagtgcgagaaagaagccgcgcaaaccgccgtcgagcttgtccgccgcaagcccgacctcaacggcgtgtaccgcctgcttggtttgaaactcagcgatttggatccggcttggaaagccgatgccgatatgatgcgttcggttatcggacggcagctacagcgcagcgtgatgtaccggtgccgaaactgccacttcaaatcacaagtctttttctggcattgtcctgcctgcaacaaatggcagacgtttacgccaaacaaaatcgaagtttaa

SEQ ID NO: 40563 - protein, 402 aa, Neisseria meningitidis
MRPNLPNSLEKADMDNELWIILLPIILLPVFFAMGWFAARVDMKTVLKQAKSIPSGFYKSLDALVDRNSGRAARELAEVVDGRPQSYDLNLTLGKLYRQRGENDKAINMHQTLLDSPDTTGAKRARVLFELAQNYQSAGLVDRAEQIFLGLQDGEMAREARQHLLNIYQQDRDWEKAVETARLLSHDDQTYQFEIAQFYCELAQAALFKSNFDAARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKCEKEAAQTAVELVRRKPDLNGVYRLLGLKLSDLDPAWKADADMMRSVIGRQLQRSVMYRCRNCHFKSQVFFWHCPACNKWQTFTPNKIEV

SEQ ID NO: 40564 - DNA, 561 bp, Neisseria gonorrhoeae
atgccgtgcctccgccggcaagcagcaaggtgtacgaaccgccgaacagaccgtcaaacagtccgctttcggtttcttcttcggcagaaacctgttcgacaggttcggcaacgggttcggcggcaacttcactggctgtttccgcaacaggttcggaaacggtgttaccggtttcgtcggtcggcgtgtcgatggcagaagcggcggcttcttgggggggcggattcggcagcggtttccgatgcggcagtatttgcagcgggtacaggtccgggttggcgttctgtcgccgaagccggagtttcggacactgcgggtttgggttcgggtcgaacggccggtttttccgcttttgcttcgggcgcggcaacttttgcttcaggtttttcaaccggtttttcgacaggtttctctatcggtttctccacagttgcctgtttggacggttcagacggcatggatgcagtttcggctttgggtttcgccgtttgcggtttgggttgttccgctttgatttttttgggtgctgccgctttgatcctgttcagattcggaatgtga

SEQ ID NO: 40565 - protein, 186 aa, Neisseria gonorrhoeae
MPCLRRQAARCTNRRTDRQTVRFRFLLRQKPVRQVRQRVRRQLHWLFPQQVRKRCYRFRRSACRWQKRRLLGGADSAAVSDAAVFAAGTGPGWRSVAEAGVSDTAGLGSGRTAGFSAFASGAATFASGFSTGFSTGFSIGFSTVACLDGSDGMDAVSALGFAVCGLGCSALIFLGAAALILFRFGM

SEQ ID NO: 40566 - DNA, 1035 bp, Neisseria meningitidis
atggtttcgggcgaggaagccttcaggaagcctgccagtccggagggtgaggcaggttttgcggaagctgtttcttctgtgccgatatggttgtttgagggcaggttgtcggagaaatcggtatcgacggtttccggtttgttttcggcagtttgggcgacagattccggttcgggcgtgtcgatgacgatttcgacagggttgtacgggttgaaggtctcgggctcgtacacgctgtctgtggattcgatggcgttccaatcggcatccgcgcgtttttgggtttcttcatcctgcgtaagtgcgccggataaaatgccgttttgcgcggctgccaggctgtcgaaatccaagtcgatgcggttggaaggcgtatcggtttcgacatcgaacgtttgttttgccgataactcttcttcagattccccatctaaggcaagtgtgtcgtttacatcgtttttcggagcgggttcgggcgttgccggagtttcgacttcggcaaaggtgatttctatgccgtcgtctgccgcgtcgtcaaggtcaggctcttcctcagggacggattcttcggtacggcgcgcgcgtttggattgggcaaggcgcaaaagcagcagcagggcgattaatgccgcgcctccgccggcaagcagcaaggtgtacgaaccgccgaacagaccgtcaaacagtccgctttcggtttcttcttcggcagaaacctgttcgacaggttcggaaacggcgttaccggtttcgtcggtcggcgtgtcgatggcagaagcggcggcttcttggggggcggattcggcagcggtttccgatgcggcagtatttgcagcgggtacaggttcgggtcgaacggccggtttttccgcttttgcttcgggcgcggcaacttttgcttcaggtttttcaaccggtttctctaccgttgcctgtttggacggttcggacggcatggatgcggtttcggctttgggtttcgccgtttgcggtttgggttgttccgctttgatcctgttcagattcggaatgtga

SEQ ID NO: 40567 - protein, 344 aa, Neisseria meningitidis
MVSGEEAFRKPASPEGEAGFAEAVSSVPIWLFEGRLSEKSVSTVSGLFSAVWATDSGSGVSMTISTGLYGLKVSGSYTLSVDSMAFQSASARFWVSSSCVSAPDKMPFCAAARLSKSKSMRLEGVSVSTSNVCFADNSSSDSPSKASVSFTSFFGAGSGVAGVSTSAKVISMPSSAASSRSGSSSGTDSSVRRARLDWARRKSSSRAINAAPPPASSKVYEPPNRPSNSPLSVSSSAETCSTGSETALPVSSVGVSMAEAAASWGADSAAVSDAAVFAAGTGSGRTAGFSAFASGAATFASGFSTGFSTVACLDGSDGMDAVSALGFAVCGLGCSALILFRFGM

SEQ ID NO: 40568 - DNA, 1023 bp, Neisseria meningitidis
atggtttcgggcgaggaagccttcaggaagcctgccagtccggagggtgaggcaggttttgcggaagctgtttcttctgtgccgatatggttgtttgagggcaggttgtcggagaaatcggtatcgacggtttccggtttgttttcggcagtttgggcgacagattccggttcgggcgtgtcgatgacgatttcgacagggttgtacgggttgaaggtctcgggctcgtacacgctgtctgtggattcgatggcgttccaatcggcatccgcgcgtttttgggtttcttcatcctgcgtaagtgcgccggataaaatgccgttttgcgcggctgccaggctgtcgaaatccaagtcgatgcggttggaaggcgtatcggtttcgacatcgaacgtttgttttgccgacaactcttcttcagattccccatctaaggcaagtgtgtcgtttacatcgtttttcggagcgggttcgggcgttgccggagtttcgacttcggcaaaggtgatttctatgccgtcgtctgccgcgtcgtcaaggtcaggctcttcctcagggacggattcttcggtacggcgcgcgcgtttggattgggcaaggcgcaaaagcagcagcagggcgatcaatgccgcgcctccgccggcaagcagcaaggtgtacgaaccgccgaacagtccgctttcggtttcttcttcggcagaaacctgttcgacaggttcggaaacggcgttaccggtttcgtcggtcggcgtgtcgatggcagaagcggcggcttcttggggggcggattcggcagcggtttccgatgcggcagtatttgcagcgggtacaggttcgggtcgaacggccggtttttccgcttttgcttcgggcgcggcaacttttgcttcaggtttttcaaccggtttctctaccgttgcctgtttggacggttcggacggcatggatgcggtttcggctttgggtttcgccgtttgcggtttgggttgttccgctttgatcctgttcagattcggaatgtga

SEQ ID NO: 40569 - protein, 340 aa, Neisseria meningitidis
MVSGEEAFRKPASPEGEAGFAEAVSSVPIWLFEGRLSEKSVSTVSGLFSAVWATDSGSGVSMTISTGLYGLKVSGSYTLSVDSMAFQSASARFWVSSSCVSAPDKMPFCAAARLSKSKSMRLEGVSVSTSNVCFADNSSSDSPSKASVSFTSFFGAGSGVAGVSTSAKVISMPSSAASSRSGSSSGTDSSVRRARLDWARRKSSSRAINAAPPPASSKVYEPPNSPLSVSSSAETCSTGSETALPVSSVGVSMAEAAASWGADSAAVSDAAVFAAGTGSGRTAGFSAFASGAATFASGFSTGFSTVACLDGSDGMDAVSALGFAVCGLGCSALILFRFGM

SEQ ID NO: 40570 - DNA, 648 bp, Neisseria gonorrhoeae; identical to SEQ ID NO: 38747

SEQ ID NO: 40571 - protein, 215 aa, Neisseria gonorrhoeae; identical to SEQ ID NO: 38748

SEQ ID NO: 40572 - DNA, 669 bp, Neisseria meningitidis; identical to SEQ ID NO: 38745

SEQ ID NO: 40573 - protein, 222 aa, Neisseria meningitidis; identical to SEQ ID NO: 38746

SEQ ID NO: 40574 - DNA, 819 bp, Neisseria meningitidis; identical to SEQ ID NO: 38749

SEQ ID NO: 40575 - protein, 272 aa, Neisseria meningitidis; identical to SEQ ID NO: 38750

SEQ ID NO: 40576 - DNA, 819 bp, Neisseria gonorrhoeae; identical to SEQ ID NO: 38753

SEQ ID NO: 40577 - protein, 272 aa, Neisseria gonorrhoeae; identical to SEQ ID NO: 38754

SEQ ID NO: 40578 - DNA, 819 bp, Neisseria meningitidis; identical to SEQ ID NO: 38751

SEQ ID NO: 40579 - protein, 272 aa, Neisseria meningitidis; identical to SEQ ID NO: 38752

SEQ ID NO: 40580 - DNA, 819 bp, Neisseria meningitidis; identical to SEQ ID NO: 38749

SEQ ID NO: 40581 - protein, 272 aa, Neisseria meningitidis; identical to SEQ ID NO: 38750

SEQ ID NO: 40582 - DNA, 483 bp, Neisseria gonorrhoeae
atggaaaggagcggtgtatttggtaaaattgtcggcaatcgcatactccgtatgccgtccgaacacgctgccgcattctatccgaaaccgtgcaaatcgtttaaactaacgcaatcttggttcagagtgcgaagctgtccgtgcggcgtttttatttacggagcaaacatgaaacttatctataccgtcatcaaaatcattatcctgctgctcttcctgctgcttgccgtcattaatatggatgccgttaccttttcctatcttccggggcagagtgtcaatctgccgctgattgtcgtattgttcggcgcgtttgtcgtcggcatcgtgttcggaatgtttgccctgttcgggcggctgctgtccttgcgcggcgaaaacagccgcctgcgtgcggaagtgaagaaaagtgcgcgcttgagcggacagaaattgactgcaccgccgatacaaaatgctgccgaatctgccaaacagccttaa

SEQ ID NO: 40583 - protein, 160 aa, Neisseria gonorrhoeae
MERSGVFGKIVGNRILRMPSEHAAAFYPKPCKSFKLTQSWFRVRSCPCGVFIYGANMKLIYTVIKIIILLLFLLLAVINMDAVTFSYLPGQSVNLPLIVVLFGAFVVGIVFGMFALFGRLLSLRGENSRLRAEVKKSARLSGQKLTAPPIQNAAESAKQP

SEQ ID NO: 40584 - DNA, 483 bp, Neisseria meningitidis
atggaaaggaacggtgtatttggtaaaattgtcggcaatcgcatactccgtatgtcgtccgaacacgctgccgcatcctatccgaaaccgtgcaaatcgtttaaactagcgcaatcttggttcagagtgcgaagctgtctgggcggcgtttttatttacggagcaaacatgaaacttatctataccgtcatcaaaatcattatcctgctgctcttcctgctgcttgccgtcattaatacggatgccgttaccttttcctacctgccggggcaaaaattcgatttgccgctgattgtcgtattgttcggcgcatttgtagtcggtattatttttggaatgtttgccttgttcggacggttgttgtcgttacgtggcgagaacggcaggttgcgtgccgaagtaaagaaaaatgcgcgtttgacggggaaggagctgaccgcaccaccggcgcaaaatgcgcccgaatctaccaaacagccttaa

SEQ ID NO: 40585 - protein, 160 aa, Neisseria meningitidis
MERNGVFGKIVGNRILRMSSEHAAASYPKPCKSFKLAQSWFRVRSCLGGVFIYGANMKLIYTVIKIIILLLFLLLAVINTDAVTFSYLPGQKFDLPLIVVLFGAFVVGIIFGMFALFGRLLSLRGENGRLRAEVKKNARLTGKELTAPPAQNAPESTKQP

SEQ ID NO: 40586 - DNA, 483 bp, Neisseria meningitidis
atggaaaggaacggtgtatttggtaaaattgtcggcaatcgcatactccgtatgtcgtccgaacacgctgccgcatcctatccgaaaccgtgcaaatcgtttaaactagcgcaatcttggttcagagtgcgaagctgtccgggcggcgtttttatttacggagcaaacatgaaacttatctataccgtcatcaaaatcattatcctgctgctcttcctgctgcttgctgtcattaatacggatgccgttaccttttcctacctgccggggcaaaaattcgatttgccgctgattgtcgtattgttcggcgcgtttgtcgtcggcatcgtgttcggaatgtttgccttgttcggacggttgttgtcgttacgtggcgagaacggcaggttgcgtgccgaagtaaagaaaaatgcgcgtttgacggggaaggagctgaccgcaccaccggcgcaaaatgcgcccgaatctgccaaacagccttga

SEQ ID NO: 40587 - protein, 160 aa, Neisseria meningitidis
MERNGVFGKIVGNRILRMSSEHAAASYPKPCKSFKLAQSWFRVRSCPGGVFIYGANMKLIYTVIKIIILLLFLLLAVINTDAVTFSYLPGQKFDLPLIVVLFGAFVVGIVFGMFALFGRLLSLRGENGRLRAEVKKNARLTGKELTAPPAQNAPESAKQP

SEQ ID NO: 40588 - DNA, 321 bp, Neisseria gonorrhoeae
atgggaaagctcgacatcgggatattgtttgccgatttcttcaaagatttcgcgccacagttcggtggtttccaaaacgttggctttgcctacggagcagacttttttgctgcgtttttgggcggattggaaggccacgtgggcgatgcggcggatttcgctttcgctgtatttcatggtgttgtagccttcgtgttcgccgttttccaaaacacggatgccgcgcggttcgccgaaataaatatcgccggtaagttcgcgcacaatcaaaatatccaaaccggcaacgatttcaggcttgagcgtggaggcgttggctaa

SEQ ID NO: 40589 - protein, 106 aa, Neisseria gonorrhoeae
MGKLDIGILFADFFKDFAPQFGGFQNVGFAYGADFFAAFLGGLEGHVGDAADFAFAVFHGVVAFVFAVFQNTDAARFAEINIAGKFAHNQNIQTGNDFRLERGGVG

SEQ ID NO: 40590 - DNA, 300 bp, Neisseria meningitidis
atgggaaagctcgacatcagggtactctttgccgatttcttcaaagatttcgcgccacaattcggtggtttccaaaacgttggctttgcctacggaacagacttttttgctgcgtttttgggcggattggaaggcaacatgggcaatacggcggatttcgctttcgctgtatttcatggtgttgtagccttcgcgttcgccgttttccagaacgcggatgccgcgcggttcgccgaaatagatgtcgccggtgagttcgcgcacaatcaaaatatccaaaccggcaacgatttcaggctt

SEQ ID NO: 40591 - protein, 106 aa, Neisseria meningitidis
MGKLDIRVLFADFFKDFAPQFGGFQNVGFAYGTDFFAAFLGGLEGNMGNTADFAFAVFHGVVAFAFAVFQNADAARFAEIDVAGEFAHNQNIQTGNDFRLQRGGVG

SEQ ID NO: 40592 - DNA, 321 bp, Neisseria meningitidis
atgggaaagctcgacatcagggtattctttgccgatttcttcaaagatttcgcgccacaattcggtggtttccaaaacgttggctttgcctacggagcagacttttttgctgcgtttttgggcggattggaaggcgacgtgggcaatacggcggatttcgctttcgctgtatttcatggtgttgtagccttcgcgttcgccgttttccagaacacggatgccgcgcggttcgccgaaataaatatcgccggtgagttcgcgcacaatcaaaatatccaaacccgcaacgatttcagacttgagcgtggaggcgttggctag

SEQ ID NO: 40593 - protein, 106 aa, Neisseria meningitidis
MGKLDIRVFFADFFKDFAPQFGGFQNVGFAYGADFFAAFLGGLEGDVGNTADFAFAVFHGVVAFAFAVFQNTDAARFAEINIAGEFAHNQNIQTRNDFRLERGGVG

SEQ ID NO: 40594 - DNA, 696 bp, Neisseria gonorrhoeae
atgagggcggcgatgacgcgcgcgcaggtcgatgccacgctgattagttttttgtgtaatgttgccaatatcggcttattgattttggtgattattgccgcattgggacggttgggcgtttccacaacatccgtaaccgccttaatcggcggcgcgggtttggcggtggcgttgtccttaaaagaccagctgtccaattttgccgccggcgcgctgattatcctgttccgcccgttcaaagtcggcgactttatccgtgtcggcggttttgaaggatatgtccgggaaatcaaaatggtgcagacttctttgcggacgaccgacaacgaagaagtcgtgctgcccaacagcgtggtgatgggcaacagcatcgtcaaccgttccagcctgccgctttgccgcgcccaagtgatagtcggcgtcgattacaactgcgatttgaaagtggcgaaagaggcggtgttgaaagccgccgccgaacaccccttgagcgttcaaaacgaagagcggcagcccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 40595 - protein, 231 aa, Neisseria gonorrhoeae
MRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSSLPLCRAQVIVGVDYNCDLKVAKEAVLKAAAEHPLSVQNEERQPAAYITALGDNAIEITLWAWANEADRWTLQCDLNEQVVENLRKVNINIPFPQRDIHIINS

SEQ ID NO: 40596 - DNA, 696 bp, Neisseria meningitidis
atgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggctgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 40597 - protein, 231 aa, Neisseria meningitidis
MRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 40598 - DNA, 696 bp, Neisseria meningitidis
atgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccttgaaagaccagctgtccaattttgccgccggcgcgctgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 40599 - protein, 231 aa, Neisseria meningitidis; identical to SEQ ID NO: 40597

SEQ ID NO: 40600 - DNA, 849 bp, Neisseria gonorrhoeae
atggacttcaaacaatttgattttttacacctgatcagtgtttccggttgggggcatctggctgaaaaggcgtgggcgttcgggctgaaccttgccgccgcgctgcttattttcttggtcgggaaatgggcggcgaaacgcattgtcgccgtaatgagggcggcgatgacgcgcgcgcaggtcgatgccacgctgattagttttttgtgtaatgttgccaatatcggcttattgattttggtgattattgccgcattgggacggttgggcgtttccacaacatccgtaaccgccttaatcggcggcgcgggtttggcggtggcgttgtccttaaaagaccagctgtccaattttgccgccggcgcgctgattatcctgttccgcccgttcaaagtcggcgactttatccgtgtcggcggttttgaaggatatgtccgggaaatcaaaatggtgcagacttctttgcggacgaccgacaacgaagaagtcgtgctgcccaacagcgtggtgatgggcaacagcatcgtcaaccgttccagcctgccgctttgccgcgcccaagtgatagtcggcgtcgattacaactgcgatttgaaagtggcgaaagaggcggtgttgaaagccgccgccgaacaccccttgagcgttcaaaacgaagagcggcagcccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 40601 - protein, 282 aa, Neisseria gonorrhoeae
MDFKQFDFLHLISVSGWGHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSSLPLCRAQVIVGVDYNCDLKVAKEAVLKAAAEHPLSVQNEERQPAAYITALGDNAIEITLWAWANEADRWTLQCDLNEQVVENLRKVNINIPFPQRDIHIINS

SEQ ID NO: 40602 - DNA, 849 bp, Neisseria meningitidis
atggacttcaaacaatttgattttttacacctgatcagtgtttccggttgggagcatctggctgaaaaggcgtgggcgttcgggctgaaccttgccgccgcgctgcttatttttttggtcggaaaatgggcggcgaaacgcattgtcgctgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggctgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 40603 - protein, 282 aa, Neisseria meningitidis
MDFKQFDFLHLISVSGWEHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 40604 - DNA, 849 bp, Neisseria meningitidis
atggacttcaaacaatttgattttttacacctgataagtgcttccggctgggagcatctggctgaaaaggcgtgggcgttcgggctgaaccttgccgccgcgctgcttatttttttggtcggaaaatgggcggcgaaacgcattgtcgccgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccttgaaagaccagctgtccaattttgccgccggcgcgctgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 40605 - protein, 282 aa, Neisseria meningitidis
MDFKQFDFLHLISASGWEHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 40606 - DNA, 303 bp, Neisseria gonorrhoeae
atggattcgcccaaggtcgggtgcgggtggatggttttgccgatgtctgccgcgtcgcagcccatttcgatggcaaggcagacttcgccgatcatgtcgccaccgttcggaccgacaatgccgccgccgatgatgcggccggtttcggcatcgaaaatcagcttggtaaagccgttgtcgcaaccgttggcaatcgcacgaccggaagccgcccatgggaagttggctttggtaattttgcggcctgatgctttggcagacaattcggtttcaccgacccatgccacttcgggggaagtgtag

SEQ ID NO: 40607 - protein, 100 aa, Neisseria gonorrhoeae
MDSPKVGCGWMVLPMSAASQPISMARQTSPIMSPPFGPTMPPPMMRPVSASKISLVKPLSQPLAIARPEAAHGKLALVILRPDALADNSVSPTHATSGEV

SEQ ID NO: 40608 - DNA, 303 bp, Neisseria meningitidis
atggattcgcccaaggtcgggtgcgggtggatggttttgccgatgtctgccgcgtcgcagcccatttcgatggcaaggcagacttcgccgatcatatcgccaccgttcggaccgacaatgccgccgccgatgatgcggccggtttcggcatcaaaaatcagcttggtaaagccgttgtcgcaaccgttggcaatcgcacggccggaagccgcccacgggaagttggctttggtgattttgcggccggaggctttggcggacagttcggtttcgcccacccacgccacttcgggggaagtgtag

SEQ ID NO: 40609 - protein, 100 aa, Neisseria meningitidis
MDSPKVGCGWMVLPMSAASQPISMARQTSPIISPPFGPTMPPPMMRPVSASKISLVKPLSQPLAIARPEAAHGKLALVILRPEALADSSVSPTHATSGEV

SEQ ID NO: 40610 - DNA, 303 bp, Neisseria meningitidis
atggattcgcccaaggtcgggtgcgggtggatggttttgccgatgtctgccgcgtcgcagcccatttcgatggcaaggcagacttcgccgatcatgtcgccaccgttcggaccgacaatgccgccgccgatgatgcggccggtttcagcatcaaaaatcagcttggtgaaaccattgtcgcaaccgttggcaatcgcacggccggaagcagcccatgggaagttggctttggtgattttgcggccggaggctttggcagacaattcggtttcgcccacccatgccacttcaggagaagtgtaa

SEQ ID NO: 40611 - protein, 100 aa, Neisseria meningitidis
MDSPKVGCGWMVLPMSAASQPISMARQTSPIMSPPFGPTMPPPMMRPVSASKISLVKPLSQPLAIARPEAAHGKLALVILRPEALADNSVSPTHATSGEV

SEQ ID NO: 40612 - DNA, 342 bp, Neisseria gonorrhoeae
atgcacttcgcccagcttgtgggtcaaaccggtatagaacaaaatacgttctgtcgtcgtggttttacccgcatcgatatgggcggaaataccgatgttgcggtacaggctgatcggggtcttacgagccattttattagcctttcaaaattagaaacggaagtgagagaatgctttgttggcttcagccatacggtgtacttcttcacgttttttcaacgcaccgccacggccttcggacgcatcaatcaactcgcctgccaaacgcagatccatggatttctcaccacgtttgcgggccgcgtcgcgaacccaacgcattgccaaagccagacggcgtga

SEQ ID NO: 40613 - protein, 113 aa, Neisseria gonorrhoeae
MHFAQLVGQTGIEQNTFCRRGFTRIDMGGNTDVAVQADRGLTSHFISLSKLETEVRECFVGFSHTVYFFTFFQRTATAFGRINQLACQTQIHGFLTTFAGRVANPTHCQSQTA

SEQ ID NO: 40614 - DNA, 342 bp, Neisseria meningitidis
atgcacttcgcccagcttgtgggtcaaaccggtatagaacaaaatacgttctgtcgtcgtggttttacccgcgtcaatatgggcggaaataccgatgttacggtacaggctgatcggggtcttacgagccattttattagcctttcaaaattagaaacggaagtgagagaatgctttgttggcttcagccatacggtgtacttcttcacgttttttcaacgcaccgccacggccttcggacgcatcaatcaattcgcctgccaaacgcaggtccatggatttctcaccacgtttgcgggccgcatcgcgaacccagcgcattgccaaagccaaacggcgtga

SEQ ID NO: 40615 - protein, 113 aa, Neisseria meningitidis
MHFAQLVGQTGIEQNTFCRRGFTRVNMGGNTDVTVQADRGLTSHFISLSKLETEVRECFVGFSHTVYFFTFFQRTATAFGRINQFACQTQVHGFLTTFAGRIANPAHCQSQTA

SEQ ID NO: 40616 - DNA, 342 bp, Neisseria meningitidis
atgcacttcgcccagcttgtgggtcaaaccggtatagaacaaaatacgttctgtcgtcgtggttttacccgcatcgatatgggcggaaataccgatgttacggtacaggctgatcggggtcttacgagccattttattagcctttcaaaattagaaacggaagtgagagaatgctttgttggcttcagccatacggtgtacttcttcacgttttttcaacgcaccgccacggccttcggacgcatcaatcaattcgcctgccaaacgcaggtccatggatttctcaccacgtttgcgggccgcatcgcgaacccagcgcattgccaaagccaaacggcgtga

SEQ ID NO: 40617 - protein, 112 aa, Neisseria meningitidis
MHFAQLVGQTGIEQNTFCRRGFTRIDMGGNTDVTVQADRGLTSHFISLSKLETEVRECFVGFSHTVYFFTFFQRTATAFGRINQFACQTQVHGFLTTFAGRINPAHCQSQTA

SEQ ID NO: 40618 - DNA, 1113 bp, Neisseria gonorrhoeae
atgcgctatattcttttgacaggactgttgccgacggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcttggataagggcgaggcggtcattgttgttgaaaaaggcggggatgcgcttcctgccgacagtgcgggcgaaaccgccgatatctatacgcctttgagcctgatgtacgacttggacaaaaacgatttgcgcgggctgttgggcgtacgcgaacacaatccgatgtaccttatgccgttttggtataacaattcgcccaactatgccccgagttcgccgacgcgcggtacgactgtacaggaaaaattcggacagcagaaacgtgcggaaaccaaattgcaggtttcgttcaaaagcaaaattgccgaaaatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttatgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgactgggacggcatctga

SEQ ID NO: 40619 - protein, 370 aa, Neisseria gonorrhoeae
MRYILLTGLLPTASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPFWYNNSPNYAPSSPTRGTTVQEKFGQQKRAETKLQVSFKSKIAENLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDWDGI

SEQ ID NO: 40620 - DNA, 1113 bp, Neisseria meningitidis
atgcgctatattcttttgacaggactgttgccgatggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcctggataagggcgaggcggtcattgttgttgaaaaaggcggggatgcgcttcctgccgacagtgcgggcgaaaccgccgacatctatacgcctttgagcctgatgtacgacttggacaaaaacgatttgcgcgggctgttgggcgtacgcgaacacaatccgatgtaccttatgccgctctggtacaacaattcgcccaactatgccccgggttcgccgacgcgcggtacgactgtacaggaaaaattcggacagcagaaacgtgcggaaaccaaattgcaggtttcgttcaaaagcaaaattgccgaagatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttacgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgacttggacggcatctga

SEQ ID NO: 40621 - protein, 370 aa, Neisseria meningitidis
MRYILLTGLLPMASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPLWYNNSPNYAPGSPTRGTTVQEKFGQQKRAETKLQVSFKSKIAEDLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDLDGI

SEQ ID NO: 40622 - DNA, 1113 bp, Neisseria meningitidis
atgcgctatattcttttgacaggactgttgccgatggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcctggataagggcgaggcggtcattgttgttgaaaaaggcggggatgcgcttcctgccgacagtgcgggcgaaaccgccgacatctatacgcctttgagcctgatgtacgacttggacaaaaacgatttgcgcgggctgttgggcgtacgcgaacacaatccgatgtaccttatgccgctctggtacaacaattcgcccaactatgccccgggttcgccgacgcgcggtacgactgtacaggaaaaattcggacagcagaaacgtgcggaaaccaaattgcaggtttcgttcaaaagcaaaattgccgaagatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttacgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaatcccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgacttggacggcatctga

SEQ ID NO: 40623 - protein, 370 aa, Neisseria meningitidis; identical to SEQ ID NO: 40621

SEQ ID NO: 40624 - DNA, 609 bp, Neisseria gonorrhoeae
atgataattgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcgcccggtttgtcggcggttacgccggttactgcgaccaacccgacggcaataatcgacagcgcgcccaacggcataaccttgccgataatggcggcaatcacaccgacaaacatagccagcagcgtccaagcctgaggcttgaccccgtcgggtacgggcagtgccaaaaccagggcgcacaatactgcggcaatggcgaggggtatcggtttgaaacccaatttcatcatattgacctccgtaaaaaagaccgtcccgaaaaatcggaaaaataa

SEQ ID NO: 40625 - protein, 202 aa, Neisseria gonorrhoeae
MIIDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRARFVGGYAGYCDQPDGNNRQRAQRHNLADNGGNHTDKHSQQRPSLRLDPVGYGQCQNQGAQYCGNGEGYRFETQFHHIDLRKKDRPEKSEK

SEQ ID NO: 40626 - DNA, 609 bp, Neisseria meningitidis
atgatagttgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcgcccggtttgtcggcggttacgccggttactgcgaccaacccgacggcaataatcgacagcgcgcccaacggcatggccttgccgataatggcggcaatcacaccgacaaacatggccagcagcgtccaagcctgaggcttgaccccgtcgggtacgggcagtgccaaaaccagggcgcacaatactgcggcaatggcgaggggtatcggtttgaaacccaatttcatcatattgacctccgtaaaaaagaccgtcccgaaaaatcggaaaaataa

SEQ ID NO: 40627 - protein, 202 aa, Neisseria meningitidis
MIVDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRARFVGGYAGYCDQPDGNNRQRAQRHGLADNGGNHTDKHGQQRPSLRLDPVGYGQCQNQGAQYCGNGEGYRFETQFHHIDLRKKDRPEKSEK

SEQ ID NO: 40628 - DNA, 609 bp, Neisseria meningitidis
atgatagttgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcacccggtttgtcggcggttacgccggttactgcgaccaacccgacggcaataatcgacagcgcacccaacggcatggccttgccgataatggcggcaatcacaccgataaacatggccagcagcgtccaagcctgaggcttgaccccgtcgggtacgggcagtgccaaaaccaaggcgcacaatactgcggcaatggcgaggggtatcggtttgaaacccaatttcatcatattgacctccgtaaaaaagaccgtcccgaaaaatcggaaaaataa

SEQ ID NO: 40629 - protein, 202 aa, Neisseria meningitidis
MIVDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRTRFVGGYAGYCDQPDGNNRQRTQRHGLADNGGNHTDKHGQQRPSLRLDPVGYGQCQNQGAQYCGNGEGYRFETQFHHIDLRKKDRPEKSEK

SEQ ID NO: 40630 - DNA, 705 bp, Neisseria gonorrhoeae
atgctgcgttctattttggcggcttccctgctggcggtatcttttccggcggcggctgaggcattgaattacaatattgtcgaattttccgaatcggcgggtatcgaggtggctcaggatacaatgtccgcgcgtttccaggtggcggcggaaggacgggacaaaaatgccgtcaatgccgagtttgttaaaaaattcaacaatttcaccagaaaatcgaaaaatggtagctttaaaaccgaattggtatcgcgcagtgcgatgccgcgctatcaatataccaacggcagacgcattcaaacaggctgggaggagcgtgcggaatttaaggcggagggcagggattttgatgctttaaaccgttttattgctgatgttcagacggatgcttcgcttgaagataccgatttcagcgtgtcgcgcgaacgccgaaacgaggtcatcgatcaggtcagcaaggatgccgttttgcgtttcaaggcgcgtgccgaaaaactggcgggcgttctgggtgcgtccggttataaaatcgtcaaattgaattttgggcaaatcggcagccatattgcgggcgatggggctgttcgggcaaaaatgctgcgcgcgatgccgatggcggcaagcgtcaatatgaagggtacggattcagccgcaccgggtgtggaggaaatcagcatcagcatcaatgggacggttcagttctaa

SEQ ID NO: 40631 - protein, 234 aa, Neisseria gonorrhoeae
MLRSILAASLLAVSFPAAAEALNYNIVEFSESAGIEVAQDTMSARFQVAAEGRDKNAVNAEFVKKFNNFTRKSKNGSFKTELVSRSAMPRYQYTNGRRIQTGWEERAEFKAEGRDFDALNRFIADVQTDASLEDTDFSVSRERRNEVIDQVSKDAVLRFKARAEKLAGVLGASGYKIVKLNFGQIGSHIAGDGAVRAKMLRAMPMAASVNMKGTDSAAPGVEEISISINGTVQF

SEQ ID NO: 40632 - DNA, 705 bp, Neisseria meningitidis
atgttgcgtcttgttttggcggcttcgctgtcggcggtatcttttccggcagcggctgaagcattgaattacaatattgtcgaattttccgaatcggcgggtgtcgaggtggctcaggatacaatgtccgcacgtttccaagtgacggcggaaggacgggacaaaaatgccgtcaatgctgagtttgttaaaaaattcaacaagttcatcagaaaatcgaaaaatggtagctttaaaaccgaattggtatcgcgcagtgcgatgccgcgctatcaatataccaacggcagacgcattcaaacaggctgggaggagcgtgcggaatttaaggtcgaaggtagagattttgatgagttaaaccgttttattgccgatattcaagcagatgccgcgttggmatatacggatttccatgtgtcgcgcgaacgccgcaacgaggtcatckatcaggtcagcaaggatgccgttttgcgtttcaaggcgcgtgccgaaaagttggcgggcgttttgggtgcgtccggttataaaatcgtcaaattgaatttgggacacatcggcagccatatcgcgggagggggagctgctcaggcaaaaatgcttcgtgccatgccgatggcggcaagcgtcaatatggagggtgcggattccgccgcgcctggtgtggaggaaatcagcatcagcgtcaatgggacggttcagttctga

SEQ ID NO: 40633 - protein, 234 aa, Neisseria meningitidis
  misc_feature (133)..(133): Xaa can be any naturally occurring amino acid
  misc_feature (149)..(149): Xaa can be any naturally occurring amino acid
MLRLVLAASLSAVSFPAAAEALNYNIVEFSESAGVEVAQDTMSARFQVTAEGRDKNAVNAEFVKKFNKFIRKSKNGSFKTELVSRSAMPRYQYTNGRRIQTGWEERAEFKVEGRDFDELNRFIADIQADAALXYTDFHVSRERRNEVIXQVSKDAVLRFKARAEKLAGVLGASGYKIVKLNLGHIGSHIAGGGAAQAKMLRAMPMAASVNMEGADSAAPGVEEISISVNGTVQF

SEQ ID NO: 40634 - DNA, 663 bp, Neisseria meningitidis
atgttgcgttctattttggcggcttccctgctgattgtcgaattttctgaatcggcgggtgtcgaggcggttcaggatacaatgtccgcacgtttccaagtgacggcggaaggacgggacaaaaatgccgtcaatgccgagtttgttaaaaaattcaacaatttcaccagaaaatcaaaaaatggtagctttaaaaccgaattggtatcgcgcagtgcgatgccgcgctatcaatataccaacggcagacgcattcaaacaggttgggaggagcgtgcggaatttaaggtcgagggtaggaattttgatgcgttgaaccgttttattgccgatgttcaggcagatgccgcgttggaatatacggatttccatgtgtcgcgcgaacgccgcaacgaggtcatcgatcaggtcagcaaggatgccgttttgcgtttcaaggcgcgtgccgaaaagttggcgggcgttttgggtgcgtccggttataaaatcgtcaaattgaatttgggacacatcggcagccatatcgcgggagggggagctgctcaggcaaaaatgcttcgtgccatgccgatggcggcaagcgtcaatatggagggtgcggattccgccgcgcctggtgtggaggaaatcagcatcagcgtcaatgggacggttcagttctga

SEQ ID NO: 40635 - protein, 220 aa, Neisseria meningitidis
MLRSILAASLLIVEFSESAGVEAVQDTMSARFQVTAEGRDKNAVNAEFVKKFNNFTRKSKNGSFKTELVSRSAMPRYQYTNGRRIQTGWEERAEFKVEGRNFDALNRFIADVQADAALEYTDFHVSRERRNEVIDQVSKDAVLRFKARAEKLAGVLGASGYKIVKLNLGHIGSHIAGGGAAQAKMLRAMPMAASVNMEGADSAAPGVEEISISVNGTVQF

SEQ ID NO: 40636 - DNA, 696 bp, Neisseria gonorrhoeae
atgaaactgttccaacgcattttcgccacattttgcgcggttatcgtctgcgcaatctttgtggcgagtttttctttttggctggtgcagaacacccttgccgaaaaccaattcaaccaacgccgcaccatcgaaaccacattgatgggcagcattatttccgcattcaagacacggggcgacaacggcgcgcgcgaaatcctgaccgaatggaaaaacagccccgtctcatccgccgtttacgtcatacagggcgacgagaaaaaagacatcttaaaccgctatatcgacaattacaccatagaacgcgcccggctgtttgccgccaacaacccccattccaaccttgtccgcatcgaatacgaccgtttcggcgaagaatacctgttcttcattaaaggctgggacaaccaccaggcacaacgcctgcccagcccgctgtttatcccgggcctgccgcttgccccgatttggcacgaattcatcatcctctccttcatcatcattgtcggactgctgatggcatatatccttgccggcaacattgccaaacccatcagaatcttaggcaacggcatggacagggtggcagaacgagaacttgaagaccgcgtttgccaacaggttcgcgaccgcgacgacgaattggccgatgttgccatgcaattcgacacaatggtggaaaaactggaataa

SEQ ID NO: 40637 - protein, 231 aa, Neisseria gonorrhoeae
MKLFQRIFATFCAVIVCAIFVASFSFWLVQNTLAENQFNQRRTIETTLMGSIISAFKTRGDNGAREILTEWKNSPVSSAVYVIQGDEKKDILNRYIDNYTIERARLFAANNPHSNLVRIEYDRFGEEYLFFIKGWDNHQAQRLPSPLFIPGLPLAPIWHEFIILSFIIIVGLLMAYILAGNIAKPIRILGNGMDRVAERELEDRVCQQVRDRDDELADVAMQFDTMVEKLE

SEQ ID NO: 40638 - DNA, 1407 bp, Neisseria meningitidis
atgaaactgttccaacgcattttcgccacattttgcgcggttatcgtctgtgcaatctttgtggcgagtttttctttctggctggtgcagaacacccttgccgaaaaccagttcaaccaacgccgcaccatcgaaaccactttgatgggcagcatcatttccgcattccgggcacgcggggacgcgggtgcgcgcgaaatcctgacggaatggaaagacagccccgtctcatcgggcgtgtacgttatacagggcgacgagaaaaaagatatcctgaaccggtatatcgacagctataccatcgaacgcgcccggcttttcgccgccggacacccgcattccaacctcgtccatatcgaatacgaccgcttcggcgaagaatacctgttcttcaccaaagactgggacaaactccaagcccgccgcctgcccagccccctgttgatccccggcctgccgctcgccccgatttggcacgaactcatcatattgtccttcatcatcatcgtcggactgctgatggcatatatcctcgccggcaacattgccaaacccatcagaatcttaggcaacggcatggacagggtggcaaacggagaacttgaaacccgtatctcccaacaggtcgacgaccgcgacgacgaattgtcccatcttgccatccaattcgacaaaatggtggaaaaactcgaaaaactcgttgccaaagaacgccacctgctccatcacgtctcccatgaaatgcgttctccccttgcgcgcatgcaggcaattgtcggactgattcaggcgcagccccaaaaacaggagcaatatctcaaacggctggaaggcgaactgacccgcatggatacgctggccggggaactgttaaccctgtcccgtctcgaaacttccaatatggctttggaaaaagaaagcctgaaactcctgcccttcctgggcaacctggtagaagacaatcaaagcattgcccagaaaaacggacaaacggttaccctgtctgccgacggaaaaatccccgaaaacacaaccatccttgccaacgaaagctacctgtaccgcgccttcgacaacgtcatccgcaacgccgtcaactacagtcccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggttccaaaacagaaaaaagtgcgaactga

SEQ ID NO: 40639 - protein, 468 aa, Neisseria meningitidis
MKLFQRIFATFCAVIVCAIFVASFSFWLVQNTLAENQFNQRRTIETTLMGSIISAFRARGDAGAREILTEWKDSPVSSGVYVIQGDEKKDILNRYIDSYTIERARLFAAGHPHSNLVHIEYDRFGEEYLFFTKDWDKLQARRLPSPLLIPGLPLAPIWHELIILSFIIIVGLLMAYILAGNIAKPIRILGNGMDRVANGELETRISQQVDDRDDELSHLAIQFDKMVEKLEKLVAKERHLLHHVSHEMRSPLARMQAIVGLIQAQPQKQEQYLKRLEGELTRMDTLAGELLTLSRLETSNMALEKESLKLLPFLGNLVEDNQSIAQKNGQTVTLSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGSKTEKSAN

SEQ ID NO: 40640 - DNA, 1407 bp, Neisseria meningitidis
atgaaactgttccaacgcatcttcgccacattttgcgcggttatcgtctgtgcaatctttgtggcgagtttttctttctggctggtgcagaacacccttgccgaaaaccagttcaaccaacgccgcaccatcgaaaccactttgatgggcagcatcatttccgcattccgggcacgcggggacgcgggtgcgcgcgaaatcctgacggaatggaaagacagccccgtctcatcgggcgtgtacgttatacagggcgacgagaaaaaagatatcctgcaccggtatatcgacagctacaccatcgaacgcgcccggcttttcgccgccggacacccgcattccaacctcgtccatatcgaatacgaccgcttcggcgaagaatacctgttcttcaccaaagactgggacaaactccaagcccgccgcctgcccagccccctgttgatccccggcctgccgctcgccccgatttggcacgaactcatcatattgtccttcatcatcatcgtcggactgctgatggcgtacatcctcgccggcaacattgccaaacccatcagaatcttaggcaacggcatggacagggtggcaaacggagaacttgaaacccgtatctcccaacaggtcgacgaccgcgacgacgaattgtcccatcttgccatccaattcgacaaaatggtggaaaaactcgaaaaactcgttgccaaagaacgccacctgctccatcacgtctcccatgaaatgcgttctccccttgcgcgcatgcaggcaattgtcggactgattcaggcgcagccccaaaaacaggagcaatatctcaaacggctggaaggcgaactgacccgcatggatacgctggccggggaactgttaaccctgtcccgtctcgaaacttccaatatggctttggaaaaagaaagcctgaaactcctgcccttcctgggcaacctggtagaagacaatcaaagcattgcccagaaaaacggacaaacggttaccctgtctgccgacggaaaaatccccgaaaacacaaccatccttgccaacgaaagctacctgtaccgcgccttcgacaacgtcatccgcaacgccgtcaactacagtcccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggttccaaaacagaaaaaagtgcgaactga

SEQ ID NO: 40641 - protein, 468 aa, Neisseria meningitidis
MKLFQRIFATFCAVIVCAIFVASFSFWLVQNTLAENQFNQRRTIETTLMGSIISAFRARGDAGAREILTEWKDSPVSSGVYVIQGDEKKDILHRYIDSYTIERARLFAAGHPHSNLVHIEYDRFGEEYLFFTKDWDKLQARRLPSPLLIPGLPLAPIWHELIILSFIIIVGLLMAYILAGNIAKPIRILGNGMDRVANGELETRISQQVDDRDDELSHLAIQFDKMVEKLEKLVAKERHLLHHVSHEMRSPLARMQAIVGLIQAQPQKQEQYLKRLEGELTRMDTLAGELLTLSRLETSNMALEKESLKLLPFLGNLVEDNQSIAQKNGQTVTLSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGSKTEKSAN

SEQ ID NO: 40642 - DNA, 630 bp, Neisseria gonorrhoeae
atggcagcccatctcgaagaacaacaagagttagacaactttaaatatttttggaaaaccacgggcaaatggctgtttgccctgctgattttggcggcactcggctacttgggatacacggtttaccaaaaccgtgcggcttcccaaaatcaggaagcggcggcggtgctggcaaacatcgtggaaaaggcgcaaaacaaagccccgcaaagcgaaatcaatgccgaactgtccaaactccaacaaagctacccccattccatttccgccgcccaagccacgctgatggcggcggcaaccgaatttgacgcgcagcgttacgatgttgccgaaggtcatttgaaatgggtgttgtccaaccaaaaagacagcctgattcaggcgttggcggcgcagcgtctgggcgttgtgttgttgcaacaaaaaaaatacgatgccgcgcttgccgcactcgacacgccggttgaggcggacttcgcccccctgctgatggaaactaaaggcgatgtttatgccgcacaggaaaaaagccaggaagccttaaaaaactacggacaggctttggaaaaaatgcctcaagattctgtcggtcgcgaattgcttcaaatgaaactcgattcgctgaaataa

SEQ ID NO: 40643 - protein, 209 aa, Neisseria gonorrhoeae
MAAHLEEQQELDNFKYFWKTTGKWLFALLILAALGYLGYTVYQNRAASQNQEAAAVLANIVEKAQNKAPQSEINAELSKLQQSYPHSISAAQATLMAAATEFDAQRYDVAEGHLKWVLSNQKDSLIQALAAQRLGVVLLQQKKYDAALAALDTPVEADFAPLLMETKGDVYAAQEKSQEALKNYGQALEKMPQDSVGRELLQMKLDSLK

SEQ ID NO: 40644 - DNA, 630 bp, Neisseria meningitidis
atggcagcccatctcgaagaacaacaagagttagacaactttaaatatttttggaaaaccacgggcaaatggctgtttgccttgctgattttggcggcactcggctacttgggatacacggtttaccaaaaccgtaaagtttcccaaaatcaggaagcggcggcggtgctggcaaacatcgtagaaaaggcgcaaagcaaagccccgcaaagcgaaatcaatgccgaattgaccaaactccaacaaagctacccgcattccatttccgccgcccaagccacactgatggcggcggcaaccgaatttgacgcgcagcgttacgatgttgccgaaggccatttgaaatgggtgttgtccaaccaaaaagacagcctgattcaagcgttggcggcgcagcgtctgggcgttgtgttgttgcaacaaaaaaaatacgatgccgcgcttgccgcgctcgatacgccggttgaagcggacttcgcccccctgctgatggaaaccaaaggcgatgtctatgccgcacagggaaaaagccaggaagccttaaaaaactacggacaggctttagaaaaaatgcctcaagattctgtcggtcgcgaattggttcaaatgaaacttgattcgctgaaataa

SEQ ID NO: 40645 - protein, 209 aa, Neisseria meningitidis
MAAHLEEQQELDNFKYFWKTTGKWLFALLILAALGYLGYTVYQNRKVSQNQEAAAVLANIVEKAQSKAPQSEINAELTKLQQSYPHSISAAQATLMAAATEFDAQRYDVAEGHLKWVLSNQKDSLIQALAAQRLGVVLLQQKKYDAALAALDTPVEADFAPLLMETKGDVYAAQGKSQEALKNYGQALEKMPQDSVGRELVQMKLDSLK

SEQ ID NO: 40646 - DNA, 630 bp, Neisseria meningitidis
atggcagcccatttggaagaacaacaagagttggacaactttaaatatttttggaaaaccacgggcaaatggctgtttgccgtgctgattttggcggcactcggctacttgggatacacggtttaccaaaaccgtgcggcttcccaaaatcaggaagcggcggcggtgctggcaaacatcgtggaaaaggcgcaaaacaaagccccgcaaagcgaaatcaatgccgaattggccaagctccaacaaagctacccccattccatttccgccgcccaagccacgctgatggcggcagcaaccgaatttgacgcgcagcgttacgatgttgccgaaggccatttgaaatgggtattgtccaaccaaaaagacagcctgatccaggcgttggcggcgcagcgtctgggcgttgtgttgttgcaacaaaaaaaatacgatgccgcgcttgccgcactcgacacgccggttgaagcggacttcgcccccctgctgatggaaaccaaaggcgatgtctatgccgcacagggaaaaagccaggaagccttaaaaaactacggacaggctttagaaaaaatgcctcaagattctgtcggtcgcgaattggttcaaatgaaacttgattcgctgaaataa

SEQ ID NO: 40647 - protein, 209 aa, Neisseria meningitidis
MAAHLEEQQELDNFKYFWKTTGKWLFAVLILAALGYLGYTVYQNRAASQNQEAAAVLANIVEKAQNKAPQSEINAELAKLQQSYPHSISAAQATLMAAATEFDAQRYDVAEGHLKWVLSNQKDSLIQALAAQRLGVVLLQQKKYDAALAALDTPVEADFAPLLMETKGDVYAAQGKSQEALKNYGQALEKMPQDSVGRELVQMKLDSLK

SEQ ID NO: 40648 - DNA, 543 bp, Neisseria gonorrhoeae
atgaaacgtatctttttgcccgccttgcccgccatcctgcctttatccgcttatgccgacctgcccttgacgattgaagacataatgaccgacaagggaaaatggaaactggaaacttcccttacctatctgaatagcgaaaacagccgcgccgcacttgccgcaccggtttacattcaaaccggcgcaacctcgtttatccccattccgaccgaaattcaagaaaacggcagcaataccgatatgctcgccggcacgctcggtttgcgctacggactgaccggcaataccgacatttacggcagcggcagctatctgtggcacgaagaacgcaaactcgacggcaacggcaaaacccgcaacaaacggatgtccgacatatccgccggcatcagccacaccttccttaaagacggcaaaaaccccgccctaatcagctttcttgaaagcacggtttacgaaaaatcgcgcaacaaagcctcgttaatcaaaaaaagggggctttgccccttttataacttaaggataaattatgaatattaa

SEQ ID NO: 40649 - protein, 180 aa, Neisseria gonorrhoeae
MKRIFLPALPAILPLSAYADLPLTIEDIMTDKGKWKLETSLTYLNSENSRAALAAPVYIQTGATSFIPIPTEIQENGSNTDMLAGTLGLRYGLTGNTDIYGSGSYLWHEERKLDGNGKTRNKRMSDISAGISHTFLKDGKNPALISFLESTVYEKSRNKASLIKKRGLCPFYNLRINYEY

SEQ ID NO: 40650 - DNA, 870 bp, Neisseria meningitidis
atgaagcgcatctttttgcccgccttgcccgccatcctgcctttatccacttatgccgacctgcccttgacgattgaagacataatgaccgacaagggaaaatggaaactggaaacttcccttacctacctgaacagcgaaaacaaccgcgccgaacttgccgcaccggtttacattcaaaccggcgcaacctcgtttatccccattccgaccgaaatccaagaaaacggcagcaataccgatatgctcgtcggcacgctcggtttgcgctacggactgaccgggaataccgacatttacggcagcggcagctatctgtggcacgaagaacgcaaactcgacggcaacagcaaaacccgcaacaaacggatgtccgacgtatccctcggcatcagccacactttccttaaagacgacaaaaaccccgccctaatcagctttcttgaaagcacggtttacgaaaaatcgcgcaacaaagcctcgtcgggaaaatcctggctcatcggcgccaccacctacaaagccatagatccgattgtcctttccctcaccgccgcctaccgcatcaacggcagcaaaaccctttcagacggcatccgctacaaatcgggcaactacctgctgctcaaccccaacatctcatttgctgccaacgacagaatcagcctgaccggaggcatccaatggctgggcaggcagcccgaccggacggacggcaaacgggaatcctccagaaacacatccacctacgcccatttcggcgcaggtttcggtttcaccaaaaccacggctttaaacgcatccgcacgtttcaacgtttcagggcaaagcagttccgaactgaaatttggcgtacagcatacattttaa

SEQ ID NO: 40651 - protein, 721 aa, Neisseria meningitidis
  misc_feature (460)..(460): Xaa can be any naturally occurring amino acid
GDDFFFFLFALMKRIFLPALPAILPLSTYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNSKTRNKRMSDVSLGISHTFLKDDKNPALISFLESTVYEKSRNKASSGKSWLIGATTYKAIDPIVLSLTAAYRINGSKTLSDGIRYKSGNYLLLNPNISFAANDRISLTGGIQWLGRQPDRTDGKRESSRNTSTYAHFGAGFGFTKTTALNASARFNVSGQCYQNRMALMHADEFALTPARAGRAPHFNTDDSEQENCECQHMHNHAHWHKSERVERDATAMHCHIRNNSEDCQQQQPGTIMESNEWRMANSYMNLARIALCRIERNEWHCFCFMKRIFLPALPAILPLSTYADLPLTIEDIMTDKGKWKLETSLTYLNSENNRHKHKHDPHPXMKRIFLPALPAILPLSTYADLPLTIEDIMTDKGKWKLETSLTYLNSENNRMHKRIFHKNRMALFHKLFKMICRSFTWRDSAADLHPWWKMNFMKRIFLPALPAILPLSTYADLPLTIEDIMTDKGKWKLETSLTYLNSENNRTITLEPIDGIDANEADDAEACNDCRTENTRYREFHYAPATANLEWRDDCMENTSMMARYINFRMATINDCMENTSMMARYINFRMFMICRSFTWRDDCMENTMSWRDDCWRDDCMENTQ

SEQ ID NO: 40652 - DNA, 870 bp, Neisseria meningitidis
atgaagcgcatctttttgcccgccttgcccgccatcctgcctttatccgcttatgccgacctgcccttgacgattgaagacataatgaccgacaagggcaaatggaaactggaaacttcccttacctacctgaacagcgaaaacaaccgcgccgaacttgccgcaccggtttacatccaaaccggcgcaacctcgtttatccccattccgaccgaaatccaagaaaacggcagcaataccgatatgctcgttggcacgctcggtttgcgctacggactgaccgggaataccgacatttacggcagcggcagctatctgtggcacgaagaacgcaaactcgacggcaacggcaaaacccgaaacaaacggatgtccgacgtatccctcggcatcagccacaccttccttaaagacgacaaaaaccccgccctaatcagctttcttgaaagcacggtttacgaaaaatcgcgcaacaaagcctcgtcgggaaaatcctggctcatcggcgccaccacctacaaagccatcgaccccgtcgtcctctcattgaccgctgcctaccgtatcaacggcagcaaaaccctttcaagcaacaccaaatacaaagcaggcaattactggatgctgaatcccaatatatccttcgccgccaacgacagaatcagcctcacgggcggcatccaatggctgggcaagcagcccgaccgtctggacggcaaaaaagaatccgcaagaaacacatccacctatgcccatttcggcgcaggtttcggtttcaccaaaaccacggctttaaacgcatccgcacgtttcaacgtttcagggcaaagcagttccgaactgaaatttggcgtacagcatacgttttaa

SEQ ID NO: 40653 - protein, 289 aa, Neisseria meningitidis
MKRIFLPALPAILPLSAYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNGKTRNKRMSDVSLGISHTFLKDDKNPALISFLESTVYEKSRNKASSGKSWLIGATTYKAIDPVVLSLTAAYRINGSKTLSSNTKYKAGNYWMLNPNISFAANDRISLTGGIQWLGKQPDRLDGKKESARNTSTYAHFGAGFGFTKTTALNASARFNVSGQSSSELKFGVQHTF

SEQ ID NO: 40654 - DNA, 390 bp, Neisseria gonorrhoeae
atgcttaaacatctcgcattcctactgcccgccatgatgttcgccctccccgcccagaccgccgtcctaagcccctatcaggaaaccggctgcacctacgaaggcgggatcggaaaagacgggcttccttcaggcaaaggcatatggcgttgccgggatgggcgcggttataccggttcattcaaaaacggcaaattcgacgggcaaggcgtttataccgttgccgccggccgcgaagtatttctcgagccgttcaattccgacagtaccaaattccgcaatatggcattgtcgggcacgttcaaacaaggcttggcacacggcaggttcgccgcctcgcaaaacggcgaaaccctcttttattatgaaatgcgaacacggcatgattaa

SEQ ID NO: 40655 - protein, 129 aa, Neisseria gonorrhoeae
MLKHLAFLLPAMMFALPAQTAVLSPYQETGCTYEGGIGKDGLPSGKGIWRCRDGRGYTGSFKNGKFDGQGVYTVAAGREVFLEPFNSDSTKFRNMALSGTFKQGLAHGRFAASQNGETLFYYEMRTRHD

SEQ ID NO: 40656 - DNA, 417 bp, Neisseria meningitidis
atgcttaaacatctcgcattcctactgcccgccatgatgttcgccctccccacttcggccgccgtcctgacttcctatcaagaaccaggctgcacctacgacggcaatgtcggcaaagacggtaaacccgccggcaaaggcacatggcgctgccaagacgggcgcaactataccggttcgtttaaaaacggcaaattcgacgggcaaggcgtttataccgttgccgccaaccgcgaaatatttatcgaaccgttcaattccgacagtaccaaattccgcaacatggtactctcgggcacgttcaaaaaaggcttggcacacggcagatttaccgtctcgcaaaacggcgaaaccctcttcattatgaaatgcgaaaacggcatgattaaagaagtgaaactgcccaaaaacaaataa

SEQ ID NO: 40657 - protein, 138 aa, Neisseria meningitidis
MLKHLAFLLPAMMFALPTSAAVLTSYQEPGCTYDGNVGKDGKPAGKGTWRCQDGRNYTGSFKNGKFDGQGVYTVAANREIFIEPFNSDSTKFRNMVLSGTFKKGLAHGRFTVSQNGETLFIMKCENGMIKEVKLPKNK

SEQ ID NO: 40658 - DNA, 417 bp, Neisseria meningitidis
atgcttaaacatctcgcattcctactgcccgccatgatgttcgccctccccgccgcgtccgccgttctgacttcctatcaagaacccggctgcacctacgaaggcgatgtcggcaaagacggtaaacccgccggcaaaggcacatggcgctgccaagacgggcgcaactataccggttcgtttaaaaatggcaaattcgacggacaaggcgtttataccgttgccgccaaccgcgaaatatttatcgaaccgttcaattccgacagtaccaaattccgcaacatggtactctcgggcacattcaaaaaaggcttggcacacggcagatttaccgtctcgcaaaacggcgaaaccctcttcattatgaaatgcgaaaacggcatgattaaagaagtgaagctgcccaaaaacaaataa

SEQ ID NO: 40659 - protein, 138 aa, Neisseria meningitidis
MLKHLAFLLPAMMFALPAASAVLTSYQEPGCTYEGDVGKDGKPAGKGTWRCQDGRNYTGSFKNGKFDGQGVYTVAANREIFIEPFNSDSTKFRNMVLSGTFKKGLAHGRFTVSQNGETLFIMKCENGMIKEVKLPKNK

SEQ ID NO: 40660 - DNA, 2178 bp, Neisseria gonorrhoeae
atgcaacaaaaaatccgtttccaaatcgaggcgatgacctgtcaggcatgtgcttcgcgcattgaaaaagtgttgaacaaaaaagattttgtcgaatcggcgggagtgaactttgccagtgaggaagcgcaggttacgtttgacggcagcaaaacctcggttgccgacattgccaaaatcattgagaaaaccggttacggcgcgaaggaaaaaacggaagatacattgccgcaacctgaagcagaacaccatatcggctggcggttgtggcttttgctgaccatcaatatcccgttccttatcggtatggtagggatgatgctaaaagggctgaattggacacggcacgattggatgattccgcctgtatggcagtttgtactggcaagcatagtgcaactttggctggcaatcccgttttacaaaagcgcgtgggcaagcattaaaggcgggctggcgaatatggacgtactcgttaccatcggcacggtgtcgatttacctgtattccgtttatatgctgtttttcagttcgcatgcggcgcacggtatggcgcatgtgtattttgaagcgggcgtgatggtgatcggttttgtgtcgctgggtaagtttttggaacaccgcaccaaaaaatccagcctgaacagcttgggcttactgctaaaactcacgccgacccaagtcaacgtgcaacgcaacggcgaatggaaacaactgcccatcgaccaagtgcaaatcggcgaccttatccgcaccaaccacggcgaacgcatcgctgccgacggcattatcgaaagcggcagcggttgggcggacgaaagccaccttaccggcgaatccaatcccgaagagaaaaaggcgggcggcaaagtgttggcgggcgcgctgatgaccgaaggcagcgtggtgtaccgcgccgcgcagctcggcagccaaaccctgctcggcgacatgatgaacgcgctctctgaagcacaaggcagtaaagcaccgattgcgcgcgtggccgataaagcggcggcggtatttgtgccaactgtcgtgggcatcgcgcttctgacttttatcgttgcttggctgattaagggcgattggacggtcgcactgatgcacgccgttgccgttttggtgattgcctgcccgtgcgcgctcggtctggcgacccctgccgcgattatggtcggcatgggcaaagcggtgaaacacggcatttggtttaaagacgcggcggcaatggaggaagcagcccacgtcgatgccgtcgtattggacaaaaccggtacgctgaccgaaggcaggccgcaggttgccgccgtttattacgttcccgacagcggctttgacgaagacgctttgtaccgcatcgccgccgccgtcgagcaaaacgccgcccacccgctcgcccgcgccatcgtctccgccgcacaagcgcgcggtttggagattcccgctgcacaaaatgcgcaaaccgttgtcggagcaggcattaccgccgaagtggaaggcgtgggtttggtgaaatcaggcaaagccgaatttgccgaactgaccttgccgaagttttcagacggcgtttgggaaatcgccagtgcggttaccgtatctgtaaacggcaaaccgatcggcgcattcgcactctccgacgcgttgaaagccgataccgccgaagccataggccgtctgaaaaaacacaatatcgatgtctatattatgagcggcgataaccaaagtacggtcgaatacgtcgccaaacaactgggcatcgcacacgccttcggtaatatgagtccgtgcgacaaagccgccgaagtgcagaaactcaaagccgccggcaaaaccgtggcgatggtcggcgacggcatcaacgacgcgcccgcgcttgccgccgccaacgtcagcttcgccatgaaaggcggtgcggacgttgccgaacacaccgcctccgccacgctgatgcagcattcggtcaatcagctcgccgatgccctgctgatatcgcaggcaacgttggaaaacatcaagcaaaacctatttttcgccttcttctacaatatattgggcattccgctcgccgcgctcggctttttaaatcccgtcatagcaggcgcggcaatggcggcaagctcggtttcggtattgggcaatgccctgcgcctgaaatgggtaaaaatcgattga

SEQ ID NO: 40661 - protein, 725 aa, Neisseria gonorrhoeae
MQQKIRFQIEAMTCQACASRIEKVLNKKDFVESAGVNFASEEAQVTFDGSKTSVADIAKIIEKTGYGAKEKTEDTLPQPEAEHHIGWRLWLLLTINIPFLIGMVGMMLKGLNWTRHDWMIPPVWQFVLASIVQLWLAIPFYKSAWASIKGGLANMDVLVTIGTVSIYLYSVYMLFFSSHAAHGMAHVYFEAGVMVIGFVSLGKFLEHRTKKSSLNSLGLLLKLTPTQVNVQRNGEWKQLPIDQVQIGDLIRTNHGERIAADGIIESGSGWADESHLTGESNPEEKKAGGKVLAGALMTEGSVVYRAAQLGSQTLLGDMMNALSEAQGSKAPIARVADKAAAVFVPTVVGIALLTFIVAWLIKGDWTVALMHAVAVLVIACPCALGLATPAAIMVGMGKAVKHGIWFKDAAAMEEAAHVDAVVLDKTGTLTEGRPQVAAVYYVPDSGFDEDALYRIAAAVEQNAAHPLARAIVSAAQARGLEIPAAQNAQTVVGAGITAEVEGVGLVKSGKAEFAELTLPKFSDGVWEIASAVTVSVNGKPIGAFALSDALKADTAEAIGRLKKHNIDVYIMSGDNQSTVEYVAKQLGIAHAFGNMSPCDKAAEVQKLKAAGKTVAMVGDGINDAPALAAANVSFAMKGGADVAEHTASATLMQHSVNQLADALLISQATLENIKQNLFFAFFYNILGIPLAALGFLNPVIAGAAMAASSVSVLGNALRLKWVKID

SEQ ID NO: 40662 - DNA, 2163 bp, Neisseria meningitidis
atgcaacaaaaaatccgtttccaaatcgaaggcatgacctgccaggcctgcgcttcgcgcattgaaaaagtgttgaacaaaaaagattttgtcgaatcggcgggggtaaacttcgccagcgaagaggcgcaggtagtgtttgacgacagcaaaacctcagtagccgacattgccaaaatcattgagaaaaccggttacggcgcgaaggaaaaaacggaagatacattgccgcaacccgaagcagaacaccatatcggctggcggctgtggctgctgttcaccatcaacgtcccgttccttatcggcatggcggggatgatgatcggcagacacgattggatgattccgccgttgtggcagttcgcattggcaagcgtggtgcagctttggctggcaatcccgttttacaaaagcgcgtgggcgagcattaagggcggactggcgaatatggacgtgctggttaccatcggcacggtctcgatttacctgtattccgtctatatgctgtttttcagcccgcacgcggcgtacggtatggcgcatgtgtattttgaagtgggcgtgatggtgatcggttttgtgtcactgggtaaatttttggaacaccgtaccaaaaaatccagcctcaacagcttgggcttgctgctcaaacttacaccaacccaagtcaacgtgcaacgcaacggcgaatggaaacagcttcccatcgaccaagtgcaaatcggcgaccttatccgcgccaaccacggcgaacgcattgccgcagacggcatcattgaaagcggcagcggttgggcggacgagagccatcttaccggcgaatccaatcctgaagaaaaaaaggcgggcggcaaagtgttggcgggcgcgttaatgaccgaaggcagtgtggtgtaccgcgccacgcagctcggcagccaaacccagctcggcgacatgatgaacgcgctctctgaagcacaaggcagtaaagcaccgattgcgcgcgtagccgataaagcggctgcggtattcgtgcctgccgtcgtgggcattgcgttgttgacttttattgttacttggctgattaagggcgattggacggttgcgctgatgcacgccgtcgccgttttggtgattgcctgcccgtgcgcgctgggtctggcaacccctgccgcgattatggtcggtatgggcaaagcggttaaacacggtatttggtttaaagacgcggcagcaatggaggaagccgcccacgtcgatgccgtcgtgttggacaaaaccggtacgctgaccgaaggcagcccgcaggttgccgccgtttattgcgttcccgacagcggctttgacgaagacgctttgtaccgcatcgccgccgccgtcgaacaaaacgccgcccatccgctcgcccgtgccatcgtctccgccgcccaagcgcgcggtttggacattcccgccgcacaaaacgcacaaaccgttgtcggcgcaggcattaccgccgaagtggaaggcgtgggtttggtgaaagcaggcaaagccgaatttgccgaactggccttgccgaagtttttagacggcgtttgggatattgcaagcattgttgcggtctcagtcgataacaaacccatcggcgcattcgcacttgccgacgcgttgaaagccgataccgccgaagccataggccgtctgaaaaaacacaatatcgatgtctatattatgagcggcgacaaccaaggcacggtcgaatacgtcgccaaacaactgggcatcgcacacgccttcggcaacatgagtccgcgcgataaagctgccgaagtgcaaaaactcaaagccgccggcaaaaccgtggcgatggtcggcgacggcatcaacgacgcgcccgcgcttgccgccgctaacgtcagcttcgccatgaaaggcggagcggacgttgccgaacataccgcatccgccacgctgatgcagcattcggtcaaccaactcgccgatgctctgctggtgtcgcaagccactttgaaaaacatcaagcaaaacctgtttttcgccttcttctacaatattttgggcattcctctcgccgcgcttggctttttaaatcccgtcatcgctggcgcggcaatggcggcaagctcggtttccgtgttgagcaatgccttgcgcctgaaacgggtaaaaatcgattag

SEQ ID NO: 40663 - protein, 720 aa, Neisseria meningitidis
MQQKIRFQIEGMTCQACASRIEKVLNKKDFVESAGVNFASEEAQVVFDDSKTSVADIAKIIEKTGYGAKEKTEDTLPQPEAEHHIGWRLWLLFTINVPFLIGMAGMMIGRHDWMIPPLWQFALASVVQLWLAIPFYKSAWASIKGGLANMDVLVTIGTVSIYLYSVYMLFFSPHAAYGMAHVYFEVGVMVIGFVSLGKFLEHRTKKSSLNSLGLLLKLTPTQVNVQRNGEWKQLPIDQVQIGDLIRANHGERIAADGIIESGSGWADESHLTGESNPEEKKAGGKVLAGALMTEGSVVYRATQLGSQTQLGDMMNALSEAQGSKAPIARVADKAAAVFVPAVVGIALLTFIVTWLIKGDWTVALMHAVAVLVIACPCALGLATPAAIMVGMGKAVKHGIWFKDAAAMEEAAHVDAVVLDKTGTLTEGSPQVAAVYCVPDSGFDEDALYRIAAAVEQNAAHPLARAIVSAAQARGLDIPAAQNAQTVVGAGITAEVEGVGLVKAGKAEFAELALPKFLDGVWDIASIVAVSVDNKPIGAFALADALKADTAEAIGRLKKHNIDVYIMSGDNQGTVEYVAKQLGIAHAFGNMSPRDKAAEVQKLKAAGKTVAMVGDGINDAPALAAANVSFAMKGGADVAEHTASATLMQHSVNQLADALLVSQATLKNIKQNLFFAFFYNILGIPLAALGFLNPVIAGAAMAASSVSVLSNALRLKRVKID

SEQ ID NO: 40664 - DNA, 2178 bp, Neisseria meningitidis
atgcaacaaaaagtccgtttccaaatcgaaggcatgacctgccaggcatgtgcttcgcgcattgaaaaagtgttgaacaaaaaagattttgtcgaatcggcgggggtaaacttcgccagcgaagaggctcaggtagtgtttgacgacagcaaaacctcagtagccgacattgccaaaatcattgagaaaaccggttacggcgcgaaggaaaaaacggaagatacattgccgcaacccgaagcagaacaccatatcggctggaggttgtggcttttgctggccatcaatatcccgttccttatcggtatggtagggatgatgctaaaagggctgaattggacacggcatgattggatgttgtcgcccttgttgcagtttgcattggcgagtgtggtgcagctttggctggcggtgccattttacaaaagcgcgtgggcgagcattaaaggcgggctggcgaatatggacgtactcgttaccatcggcacggtctcgatttacctgtattccgtctatatgctgtttttcagcccgcacgcggcgtacggtatggcgcatgtgtattttgaagtaggcataatggtgattggttttgtgtcactgggtaaatttttggaacaccgcaccaaaaaatccagcctgaacagcttgggcttgctgctcaaactcacgccaacccaagtcaacgtgcaacgcgatggcgaatggcggcagctacccatcgaccaagtgcaaatcggcgacctaatccgcgccaatcacggcgaacgcattgccgccgacggcatcatagaaagcggcagcggctgggcggacgaaagccatcttaccggcgaatccaatcccgaagagaaaaaggcaggcggcaaagtattggcgggcgcgctgatgactgaaggcagcgtggtgtaccgcgccgcgcagctcggcagccaaaccctgctcggcgacatgatgaacgcgctctccgaagcgcaaggcagtaaagcaccgattgcgcgtgtggcggacaaggcggcggcggtattcgtgcctgccgttgtgggcatcgcacttttgacttttatcgctacttggctgattaagggcgattggacgctcgcattgatgcacgccgtcgccgttttggtgattgcctgcccgtgtgcactcggtttggcaacccctgctgcgattatggtcggtatgggcaaagcggttaaacacggtatttggtttaaagacgcggcagcaatggaagaagccgcccacgttgatgccgtcgtgctggacaaaaccggcacgctgaccgaaggcaagccgcaggttgccgccgtttattgtgttcccgacagcggctttgacgaagacgctttgtaccgcatcgccgccgccgtcgaacaaaacgccgcccatccgctcgcccgtgccatcgtctccgccgcccaggcgcgcggtttggagattcccaccgcacaaaatgcccaaaccattgtcggcgcgggcattaccgccgaagtaaaaggcgcgggtttggtaaaagcaggcaaagccgaatttgccgaactgaccttgccgaagttttcagacggcgtttgggaaatcgccagtgtggttgccgtatctgtaaacggcaaacctatcggcgcattcgcactcgccgacgcgttgaaagccgataccgccgaagccataggccgtctgaaaaaacacaatatcgatgtctatattatgagcggcgataaccaaggcacggtcgagtacgtcgccaaacaactgggcatcgcacacgccttcggtaatatgagtccgcgcgacaaagccgccgaagtgcagaaactcaaagccgccggcaaaaccgtggcgatggtcggcgacggcatcaacgacgcgcccgcgctcgccgccgccaacgtcagcttcgccatgaaaggcggtgcagacgttgccgaacacaccgcatccgccacactgatgcagcattcggtcaaccagctcgccgatgcgctatcggtatcgcgagcgacgttgaaaaacatcaagcaaaacctgtttttcgccttcttctacaatattttgggcattccgctcgccgcgctcggctttttaaaccccgtcatcgcaggcgcggcaatggcggcaagctcggtttccgtgttgagcaacgccttgcgcctgaaacgggtaaaaatcgattga

SEQ ID NO: 40665 - protein, 725 aa, Neisseria meningitidis
MQQKVRFQIEGMTCQACASRIEKVLNKKDFVESAGVNFASEEAQVVFDDSKTSVADIAKIIEKTGYGAKEKTEDTLPQPEAEHHIGWRLWLLLAINIPFLIGMVGMMLKGLNWTRHDWMLSPLLQFALASVVQLWLAVPFYKSAWASIKGGLANMDVLVTIGTVSIYLYSVYMLFFSPHAAYGMAHVYFEVGIMVIGFVSLGKFLEHRTKKSSLNSLGLLLKLTPTQVNVQRDGEWRQLPIDQVQIGDLIRANHGERIAADGIIESGSGWADESHLTGESNPEEKKAGGKVLAGALMTEGSVVYRAAQLGSQTLLGDMMNALSEAQGSKAPIARVADKAAAVFVPAVVGIALLTFIATWLIKGDWTLALMHAVAVLVIACPCALGLATPAAIMVGMGKAVKHGIWFKDAAAMEEAAHVDAVVLDKTGTLTEGKPQVAAVYCVPDSGFDEDALYRIAAAVEQNAAHPLARAIVSAAQARGLEIPTAQNAQTIVGAGITAEVKGAGLVKAGKAEFAELTLPKFSDGVWEIASVVAVSVNGKPIGAFALADALKADTAEAIGRLKKHNIDVYIMSGDNQGTVEYVAKQLGIAHAFGNMSPRDKAAEVQKLKAAGKTVAMVGDGINDAPALAAANVSFAMKGGADVAEHTASATLMQHSVNQLADALSVSRATLKNIKQNLFFAFFYNILGIPLAALGFLNPVIAGAAMAASSVSVLSNALRLKRVKID

SEQ ID NO: 40666 - protein, 1551 aa, Neisseria gonorrhoeae
ATGAAAAAACCTTTGATTTCAGTTGCGGCAGTATTGCTCGGCGTTGCTTTGGGTACACCTTATTATTTGGGTGTCAAAGCAGAAGAAAGTCTGACGCAGCAGCAAAAAATATTGCAGAAAACGGGCTTTTTGACCGTCGAATCGCACCAGTATGATCGAGGCTGGTTTACCTCTACGGAAACGACGGTCATCCGTCTGAAACCCGAGTTGCTGCATAATGCGCAGAAATACCTGCCGGATAACTTGAAAATAGTGTTGGAACAGCCGGTTACGCTGGTAAACCATATCACGCACGGCCCTTTCGCCGGCGGATTCGGCACGCAGGCGCACATTGAAACCGAGTTCAAATACGCGCCTGAAACGGAAAAAGTTTTGGAACGCTTTTTTGGGAAACAAGTTCCGGTTTCCCTTGCCAATACCGTTTATTTCAACGGCAGCGGTAAAATGGAAGTCAGTGTTCCCGCTTTCGATTATGAAGAACTGTCGGGCATCAGGCTGCACTGGGAAGGCCTGACGGGGGAAACGGTTTATCAAAAAGGTTTCAAAAGCTACCGCAACAGCTATGATGCGCCCTTGTTCAAAATCAAGCTGGCAGACAAAGGCGATGCCGCGTTTGAAAAAGCGCATTTCGATTCGGAAACTTCAGACGGCATCAATCCGCTTGCTTTGGGCAGCAGCAATCTGACTTTGGAAAAATTTTCGCTCGAATGGAAAGAGGGTGTCGATTACAACGTCAAATTGAACGAACTGGTCAACCTCGTTACCGATTTGCAGATCGGCGCGTTTATCAATCCCAACGGCAGCATCGCACCTTCCAAAATCGAAGTCGGCAAGCTGGCTTTTTCAACCAAGACCGGGGAATCGGGCGCGTTTATCGACAGCGAAGGGCGGTTCCGTTTCGATACGTTGGTGTACGGCGATGAAAAATACGGCCCGCTGGACATCCATATCGCTGCCGAACACCTCGATGCTTCTGCCTTAACCGTATTGAAACGCAAGTTTGCACAAATTTCTGCCAAAAAAATGACTGAGGAACAAATCCGCAATGATTTGATTGCGGCAGTCAAAGGCGATGCTTCCGGATTATTTACCCATGACCCGGTACTAAATATCAAAATTTTCCGTTTCACCCTGCCTCAGGGAAAAATTGATGTGGGCGGAAAAATCATGTTTAAAGGCATGAAGAAGGAAGATTTGAACCAATTGGGACTGATGTTAAAGAAAACCGAGGCAAACATCAGAATGAGTATTCCTCAAAAAATGTTGGAAGATTTGGCGGTAAGTCAGGCTGGAAATATTTTCAGTGTAAATGCCGAAGATGAGGCGGAAGCCAGAGCAAGCATTGCCGATATTAATGAAACATTGCGCCTGATGGTGGACAGTACGGTCCAAAGTATGGCAAGGGAAAAATATCTTACTTTAGACGGTAATCAGATTGATACGGTCATTTCCCTTAAAAACAACGCCCTGAAGTTAAACGGGAAAACGCTGCAAAATGAACCCGATCCTGATTTTGACGAGGGAGATATGGTTTCCGGCCAGCCGCATTAA

SEQ ID NO: 40667 - protein, 516 aa, Neisseria gonorrhoeae
MKKPLISVAAVLLGVALGTPYYLGVKAEESLTQQQKILQKTGFLTVESHQYDRGWFTSTETTVIRLKPELLHNAQKYLPDNLKIVLEQPVTLVNHITHGPFAGGFGTQAHIETEFKYAPETEKVLERFFGKQVPVSLANTVYFNGSGKMEVSVPAFDYEELSGIRLHWEGLTGETVYQKGFKSYRNSYDAPLFKIKLADKGDAAFEKAHFDSETSDGINPLALGSSNLTLEKFSLEWKEGVDYNVKLNELVNLVTDLQIGAFINPNGSIAPSKIEVGKLAFSTKTGESGAFIDSEGRFRFDTLVYGDEKYGPLDIHIAAEHLDASALTVLKRKFAQISAKKMTEEQIRNDLIAAVKGDASGLFTHDPVLNIKIFRFTLPQGKIDVGGKIMFKGMKKEDLNQLGLMLKKTEANIRMSIPQKMLEDLAVSQAGNIFSVNAEDEAEARASIADINETLRLMVDSTVQSMAREKYLTLDGNQIDTVISLKNNALKLNGKTLQNEPDPDFDEGDMVSGQPH

SEQ ID NO: 40668 - DNA, 1388 bp, Neisseria meningitidis
tggtttacctctatggaaacgacggtcatccgtctgaaacccgagttgctgaataatgcccgaaaatacctgccggataacctgaaaacagtgttggaacagccggttacgctggttaaccatatcacgcacggccctttcgccggcggattcggcacgcaggcgtacattgaaaccgagttcaaatacgcgcctgaaacggaaaaagttctggaacgcttttttggaaaacaagtcccggcttcccttgccaataccgtttattttaacggcagcggtaaaatggaagtcagtgttcccgccttcgattatgaagagctgtcgggcatcagctgcactgggaakgcctgacgggagaaacggtttatcaaaaaggtttcaaaagctaccggaacggctatgatgcccccttgtttaaaatcaagctggcagacaaaggcgatgccgcgtttgaaaaagtgcatttcgattcggaaacttcagacggcatcaatccgcttgctttgggcagcagcaatctgaccttggaaaaattctccctagaatggaaagagggtgtcgattacaacgtcaagttaaacgaactggtcaatcttgttaccgatttgcagattggcgcgtttatcaatcccaacggcagcatcgcaccttccaaaatcgaagtcggcaaactggctttttcaaccaagaccggggaatcaggcgcgtttatcaacagtgaagggcagttccgtttcgatacactggtgtacggcgatgaaaaatacggcccgctggacatccatatcgctgccgaacacctcgatgcttctgccttaaccgtattgaaacgcaagtttgcacaaatttccgccaaaaaaatgaccgaggaacaaatccgcaatgatttgattgccgccgtcaaaggagaggcttccggactgttcaccaacaatcccgtattggacattaaaactttccgattcacgctgccatcgggaaaaatcgatgtgggcggaaaaatcatgtttaaagacatgaagaaggaagatttgaatcaattgggtttgatgctgaagaaaaccgaagccgacatcagaatgagtattccccaaaaaatgctggaagacttggcggtcagtcaagcaggcaatattttcagcgtcaatgccgaagatgaggcggaaggcagggcaagtcttgacgacatcaacgagaccttgcgcctgatggtggacagtacggttcagagtatggcaagggaaaaatatctgactttgaacggcgaccagattgatactgccatttctctgaaaaacaatcagttgaaattgaacggtaaaacgttgcaaaacgaaccggagccggattttgatgaaggcggtatggtttcagagccgcagcagtaa

SEQ ID NO: 40669 - protein, 462 aa, Neisseria meningitidis
  misc_feature (111)..(111): Xaa can be any naturally occurring amino acid
  misc_feature (116)..(116): Xaa can be any naturally occurring amino acid
WFTSMETTVIRLKPELLNNARKYLPDNLKTVLEQPVTLVNHITHGPFAGGFGTQAYIETEFKYAPETEKVLERFFGKQVPASLANTVYFNGSGKMEVSVPAFDYEELSGIXLHWEXLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFINSEGQFRFDTLVYGDEKYGPLDIHIAAEHLDASALTVLKRKFAQISAKKMTEEQIRNDLIAAVKGEASGLFTNNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 40670 - DNA, 1551 bp, Neisseria meningitidis
atgaaaaaacctttgatttcggttgcggcagcattgctcggcgttgctttgggcacgccttattatttgggtgtcaaagccgaagaaagcttgacgcagcagcaaaaaatattgcaggaagcgggcttcttgaccgtcgaatcgcaccaatatgagcgcggctggtttacctctacggaaacgacggtcatccgcttgaaacccgagttgctgcataatgcgcagaaatacctgccggataacctgaaaacagtgttggaacagccggttacgctggtaaaccatatcacgcacggtccttttgccggcggattcggcacgcaggcgtacattgaaaccgagttcaaatacgcgcctgaaacggaaaaagttctggaacgcttttttggaaaacaagtcccggtttcccttgccaataccgtttattttaacggcagcggtaaaatggaagtcagtgttcccgccttcgattatgaagagctgtcgggcatcaggctgcactgggaaggcctgacgggagaaacggtttatcaaaaaggtttcaaaagctaccggaacggctatgatgcccccttgtttaaaatcaagctggcagacaaaggcgatgccgcgtttgaaaaagtgcatttcgattcggaaacttcagacggcatcaacccgcttgctttgggcagcagcaatctgaccttggaaaaattttccttagaatggaaagagggtgtcgattacaacgtcaagttaaacgaactggtcaatcttgttaccgatttgcagattggcgcgtttatcaatcccaacggcagcatcgcaccttccaaaatcgaagtcggcaagctggctttttcaaccaagaccggggaatcgggcgcgtttatcgatagcgaagggcagttccgttttggcacgctggtttacggcgatgaaaaatacggccctctggacatccatatcgctgccgaacacctcgatgcttctgccttaaccgtattgaaacgcaagtttgcacgaatttctgccaaaaaaatgactgaagaacaaatccgcaatgatttgattgcggcagtcaaaggcgaggcttccggattatttacccataacccagtattggacattaaaactttccgattcacgctgccatcgggaaaaatcgatgtgggcggaaaaatcatgtttaaagacatgaagaaggaagatttgaaccaattgggtttgatgctgaagaaaaccgaagccgacatcagaatgagtattccccaaaaaatgctggaagacttggcggtcagtcaagcaggcaatattttcagcgtcaatgccgaagatgaggcggaaggcagggcaagtcttgacgacatcaacgagaccttgcgcctgatggtggacagtacggttcagagtatggcaagggaaaaatatctgactttgaacggcgaccagattgatactgccatttctctgaaaaacaatcagttgaaattgaacggtaaaacgttgcaaaacgaaccggagccggattttgatgaaggcggtatggtttcagagccgcagcagtaa

SEQ ID NO: 40671 - protein, 516 aa, Neisseria meningitidis
MKKPLISVAAALLGVALGTPYYLGVKAEESLTQQQKILQEAGFLTVESHQYERGWFTSTETTVIRLKPELLHNAQKYLPDNLKTVLEQPVTLVNHITHGPFAGGFGTQAYIETEFKYAPETEKVLERFFGKQVPVSLANTVYFNGSGKMEVSVPAFDYEELSGIRLHWEGLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFIDSEGQFRFGTLVYGDEKYGPLDIHIAAEHLDASALTVLKRKFARISAKKMTEEQIRNDLIAAVKGEASGLFTHNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 40672 - DNA, 1551 bp, Neisseria meningitidis
atgaaaaaacctttgatttcggttgcggcagcattgctcggcgttgctttgggcacgccttattatttgggtgtcaaagccgaagaaagcttgacgcagcagcaaaaaatattgcaggaaacgggcttcttgaccgtcgaatcgcaccaatatgagcgcggctggtttacctctatggaaacgacggtcatccgtctgaaacccgagttgctgaataatgcccgaaaatacctgccggataacctgaaaacagtgttggaacagccggttacgctggttaaccatatcacgcacggccctttcgccggcggattcggcacgcaggcgtacattgaaaccgagttcaaatacgcgcctgaaacggaaaaagttctggaacgcttttttggaaaacaagtcccggcttcccttgccaataccgtttattttaacggcagcggtaaaatggaagtcagtgttcccgccttcgattatgaagagctgtcgggcatcaggctgcactgggaaggcctgacgggagaaacggtttatcaaaaaggtttcaaaagctaccggaacggctatgatgcccccttgtttaaaatcaagctggcagacaaaggcgatgccgcgtttgaaaaagtgcatttcgattcggaaacttcagacggcatcaatccgcttgctttgggcagcagcaatctgaccttggaaaaattctccctagaatggaaagagggtgtcgattacaacgtcaagttaaacgaactggtcaatcttgttaccgatttgcagattggcgcgtttatcaatcccaacggcagcatcgcaccttccaaaatcgaagtcggcaaactggctttttcaaccaagaccggggaatcaggcgcgtttatcaacagtgaagggcagttccgtttcgatacactggtgtacggcgatgaaaaatacggcccgctggacatccatatcgctgccgaacacctcgatgcttctgccttaaccgtattgaaacgcaagtttgcacaaatttccgccaaaaaaatgaccgaggaacaaatccgcaatgatttgattgccgccgtcaaaggagaggcttccggactgttcaccaacaatcccgtattggacattaaaactttccgattcacgctgccatcgggaaaaatcgatgtgggcggaaaaatcatgtttaaagacatgaagaaggaagatttgaatcaattgggtttgatgctgaagaaaaccgaagccgacatcagaatgagtattccccaaaaaatgctggaagacttggcggtcagtcaagcaggcaatattttcagcgtcaatgccgaagatgaggcggaaggcagggcaagtcttgacgacatcaacgagaccttgcgcctgatggtggacagtacggttcagagtatggcaagggaaaaatatctgactttgaacggcgaccagattgatactgccatttctctgaaaaacaatcagttgaaattgaacggtaaaacgttgcaaaacgaaccggagccggattttgatgaaggcggtatggtttcagagccgcagcagtaa

SEQ ID NO: 40673 - protein, 516 aa, Neisseria meningitidis
MKKPLISVAAALLGVALGTPYYLGVKAEESLTQQQKILQETGFLTVESHQYERGWFTSMETTVIRLKPELLNNARKYLPDNLKTVLEQPVTLVNHITHGPFAGGFGTQAYIETEFKYAPETEKVLERFFGKQVPASLANTVYFNGSGKMEVSVPAFDYEELSGIRLHWEGLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFINSEGQFRFDTLVYGDEKYGPLDIHIAAEHLDASALTVLKRKFAQISAKKMTEEQIRNDLIAAVKGEASGLFTNNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 40674 - DNA, 1341 bp, Neisseria gonorrhoeae
ttgcaaacccttctagcttttatcttcgccatcctgattttggtcagcctgcacgaattcggacactacatcgtcgccaggttgtgcggcgtcaaggttgtgcgtttttccgtcggcttcggcaaaccgtttttcacccgaaagcgcggcgacaccgaatggtgcctcgccccgattccgttgggcggctacgtcaaaatggtcgatacgcgcgaaggcgaagtatcagaagccgatttaccctacgcttttgacaaacaacaccccgccaagcgcatcgccatcgtcgccgccggtccgctgaccaacctcgcactggcggttttgctgtacggactgagcttttccttcggcgtaaccgaactgcggccctatgtcggcacagtcgaacccgacaccgttgccgcccgcaccggcttccaaagcggcgacaaaatacaatccgtcaacggcgtttccgtccaagactggagcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaggaatgggcaaacctgacccgccaaagcccgggcaaaaaaatcaccctgacctacgaacgcgccggacaaacccataccgccgacatccgccccgatactgtcgaacagcccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctctgtcagccatatttccgggccgctgaccattgccgacattgccggacagtccgccgaactcggcttgcaaagttatttggaatttttagcgttggtcagcatcagcctcggcgtgctgaacctgctgcccgtccccgttttggacggcgggcacctcgtgttttatactgtcgaatggatacgcggcaaacctttgggcgaacgtgtccaaaacatcggtttgcgcttcgggctcgccctgatgatgctgatgatggcggccgccttcttcaacgacgttacccggctgatcggttag

SEQ ID NO: 40675 - protein, 446 aa, Neisseria gonorrhoeae
LQTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTVAARTGFQSGDKIQSVNGVSVQDWSSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLTYERAGQTHTADIRPDTVEQPDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTVEWIRGKPLGERVQNIGLRFGLALMMLMMAAAFFNDVTRLIG

SEQ ID NO: 40676 - DNA, 2682 bp, Neisseria meningitidis
ttgcacacccttctagcttttatcttcgccatcctgattttggtcagcctgcacgagttcggacactacatcgttgccagattgtgcggcgtcaaagtcgtacgcttttccgtcggcttcggcaaaccgtttttcacccgaaagcgcggcgacaccgaatggtgcctcgccccgattccgttgggcggttacgtcaaaatggtcgatacgcgcgaaggcgaagtatcagaagccgatttaccctacgcttttgacaaacaacaccccgccaagcgcatcgccatcgtcgccgccggcccactgaccaacctcgcactggcggttttgctgtacggactgagcttttccttcggcgtaaccgaactgcgcccctacgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgaactacgaacgcgccggacaaacccataccgccgacatccgccccgatactgtcgaacagtccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccgggccgctgaccattgccgacattgccggacagtccgccgaactcggcttgcaaagttatttggaatttttagcactggtcagcatcagcctcggcgtgctgaacctactgcccgtccctgttttggacggcgggcacctcgtgttttatactgccgaatggatacgcggcaaacctttgggcgaacgcgtccaaaacatcggtttgcgcttcgggctcgccctcatgatgctgatgatggcggtcgccttcttcaacgacgttacccggctgctcggttagttgcacacccttctagcttttatcttcgccatcctgattttggtcagcctgcacgagttcggacactacatcgttgccagattgtgcggcgtcaaagtcgtacgcttttccgtcggcttcggcaaaccgtttttcacccgaaagcgcggcgacaccgaatggtgcctcgccccgattccgttgggcggttacgtcaaaatggtcgatacgcgcgaaggcgaagtatcagaagccgatttaccctacgcttttgacaaacaacaccccgccaagcgcatcgccatcgtcgccgccggcccactgaccaacctcgcactggcggttttgctgtacggactgagcttttccttcggcgtaaccgaactgcgcccctacgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgaactacgaacgcgccggacaaacccataccgccgacatccgccccgatactgtcgaacagtccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccgggccgctgaccattgccgacattgccggacagtccgccgaactcggcttgcaaagttatttggaatttttagcactggtcagcatcagcctcggcgtgctgaacctactgcccgtccctgttttggacggcgggcacctcgtgttttatactgccgaatggatacgcggcaaacctttgggcgaacgcgtccaaaacatcggtttgcgcttcgggctcgccctcatgatgctgatgatggcggtcgccttcttcaacgacgttacccggctgctcggttag

SEQ ID NO: 40677 - protein, 446 aa, Neisseria meningitidis
LHTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARAGFQSGDKIQSVNGTPVADWGSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLNYERAGQTHTADIRPDTVEQSDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTAEWIRGKPLGERVQNIGLRFGLALMMLMMAVAFFNDVTRLLG

SEQ ID NO: 40678 - DNA, 1341 bp, Neisseria meningitidis
ttgcacacccttctagcttttatcttcgccatcctgattttggtcagcctgcacgaattcggacactacatcgtcgccagattgtgcggcgtcaaggttgtgcgtttttccgtcggcttcggcaaaccgtttttcacccgaaagcgcggcgacaccgaatggtgcctcgccccgattccgttgggcggttacgtcaaaatggtcgacacgcgcgaaggcgaagtatcagaagccgatttaccctacgcttttgacaaacaacaccccgccaagcgcatcgccatcgtcgccgccggcccgctgaccaacctcgcactggcggttttgctgtacggactgagcttttccttcggcgttaccgaactgcgcccctatgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgacctacgaacgcgccggacaaacccataccgccgacatccgccccgatactgtcgaacagcccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccggtccgctgaccattgccgatattgccggacagtccgccgaactcggcttgcaaagttatttggaatttttggcactggtcagcatcagcctcggcgtgctgaacctgctgcccgtccccgttttggacggcggccacctcgtgttttatactgccgaatggatacgcggcaaacctttgggcgaacgcgtccaaaacatcggtttgcgcttcgggcttgccctcatgatgctgatgatggcggtcgccttcttcaacgacgttacccggctgctcggttag

SEQ ID NO: 40679 - protein, 446 aa, Neisseria meningitidis
LHTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARAGFQSGDKIQSVNGTPVADWGSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLTYERAGQTHTADIRPDTVEQPDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTAEWIRGKPLGERVQNIGLRFGLALMMLMMAVAFFNDVTRLLG

SEQ ID NO: 40680 - DNA, 714 bp, Neisseria gonorrhoeae
atgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttatggcgatttgagcggtgcggcgctgacgcaggcggcgattgtcagccaagtggggcaatggggcgcgggtttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcatcatggcgtggatcaacctcgtcgccatcctgctgctctcgccattggcgtttatgctgctgcgcgattacaccgccaagctgaaaatgggcaaagaccccgagttcaaactttccgaacatccgggcctgaaacgccgcatcaaatccgatgtttggtaa

SEQ ID NO: 40681 - protein, 237 aa, Neisseria gonorrhoeae
MIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 40682 - DNA, 714 bp, Neisseria meningitidis
atgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttacggcgatttgagcggtgcggcgctgacgcaggcggcgattgtcagccaagtggggcaatggggcgcgggcttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcattatggcgtggatcaaccttgtcgccatcctgctgctctcgcccttggcgtttatgctgctgcgcgattacaccgccaagctgaaaatgggcaaagaccccgagttcaaactttccgaacatccgggcctgaaacgccgtatcaaatccgacgtttggtaa

SEQ ID NO: 40683 - protein, 237 aa, Neisseria meningitidis; identical to SEQ ID NO: 40681

SEQ ID NO: 40684 - DNA, 714 bp, Neisseria meningitidis; identical to SEQ ID NO: 40682

SEQ ID NO: 40685 - protein, 237 aa, Neisseria meningitidis; identical to SEQ ID NO: 40681

SEQ ID NO: 40686 - DNA, 942 bp, Neisseria gonorrhoeae
atgcttgaactgaacggactctgcaaatgcttcggcggcaaaacggtcgccgacaacatctgcctgactgtcgggcgcggcaaaatactcgccgtactggggcggtcgggctgcggcaaatccaccctgctgaatatgattgcgggcatcgtccggccggacggcggcgaaattcggctgaacggggaaaacattacctgtatgccgcccgaaaaacgccgtatctcgctgatgtttcaagattacgcgctgtttccccatatgagtgcgctggaaaatacggcattcggtttgaaaatgcaaaaaatgccgaaagccgaagccgaacgcctcgccttgtcggcacttgccgaagtcgggctggaaaacgaggcgcaccgcaagcctgaaaaactttccggaggcgagaagcaacggttggcactggcgcgcgctttggttgtccgcccttccctgctgttgctggatgaatcgttttccagtttggacacgcatttgcgcgaccggctgcgccgtatgaccgccgaacgcatccgcaagggcggcatccctgccgttttggtaacgcattcgcccgaagaggcctgcacggcggcggacgaaatcgccgtcatgcacgaggggaaaatccttcaatgcggtacgcccgaaaccttgattcaaacgcctgccggcgtgcaggtcgcccgtctgatggggctgcccaataccgacgatgaccgccatattccgcaaaatgccgtgtgcttggacaatcatggaacggaatgccgtctgctgtccctcgtccgcctgcccgactcgctccggctttccgccgtccatcccgaacacggcgagctgaccttaaacctgactgtcggacaacatacggacggtatttccggaaacggtacggtccgcatccgcgtcgatgaagggcgtatcgtccgtttccgatga

SEQ ID NO: 40687 - protein, 313 aa, Neisseria gonorrhoeae
MLELNGLCKCFGGKTVADNICLTVGRGKILAVLGRSGCGKSTLLNMIAGIVRPDGGEIRLNGENITCMPPEKRRISLMFQDYALFPHMSALENTAFGLKMQKMPKAEAERLALSALAEVGLENEAHRKPEKLSGGEKQRLALARALVVRPSLLLLDESFSSLDTHLRDRLRRMTAERIRKGGIPAVLVTHSPEEACTAADEIAVMHEGKILQCGTPETLIQTPAGVQVARLMGLPNTDDDRHIPQNAVCLDNHGTECRLLSLVRLPDSLRLSAVHPEHGELTLNLTVGQHTDGISGNGTVRIRVDEGRIVRFR

SEQ ID NO: 40688 - DNA, 939 bp, Neisseria meningitidis
atgcttgaactgaacggactctgcaaacgcttcggcaataaaaccgtcgccgacaacatctgcctgactgtcgggcgcggcaaaatactcgccgttttggggcggtcgggctgcggaaaatccaccctgctgaatataattgcggggattgtccggccggacggcggggaaatatggctgaacggagaaaacattacccgtatgccgcccgaaaaacgccgtatctcgctgatgtttcaagattacgcgctgtttccccatatgagtgcgctggaaaatgcggcattcggtttgaaaatgcaaaaaatgccgaaagccgaagccgaacgcctcgccatggcggcacttgccgaagtcggactggaaaacgaggcgcaccgcaagcctgaaaaactttccggaggcgagaagcaacggctggcgttggcgcgcgctttggttgtccgcccttccctgctgctgttggacgaatcgttttccagtttggacacgcatttgcgcggcacgctgcgccgtatgactgccgaacgtatccgaaacggcggcatccctgccgttttggtaacgcattcgcccgaagaagcctgtacgacggcagacgaaatcgccgtgatgcataaagggaggattctacaatacggtacgcccgaaacattggtcaaaacaccatcctgcgtgcaggtcgcccgactgatgggtttgcccaataccgacgataaccgccatattccgcaacatgcggtgcgtttcgaccaagacggcatggagtgccgcgtattatcccgtacctgtttgcccgaatcgttcagcctgtccgtcctccatccggaacacggcatcctgtggctgaacctcgatatgcggcacgccggggcggtatcgggcaaggatacggtacgcatccatatcgaagaacgggaaatcgtccgcttccgctga

SEQ ID NO: 40689 - protein, 312 aa, Neisseria meningitidis
MLELNGLCKRFGNKTVADNICLTVGRGKILAVLGRSGCGKSTLLNIIAGIVRPDGGEIWLNGENITRMPPEKRRISLMFQDYALFPHMSALENAAFGLKMQKMPKAEAERLAMAALAEVGLENEAHRKPEKLSGGEKQRLALARALVVRPSLLLLDESFSSLDTHLRGTLRRMTAERIRNGGIPAVLVTHSPEEACTTADEIAVMHKGRILQYGTPETLVKTPSCVQVARLMGLPNTDDNRHIPQHAVRFDQDGMECRVLSRTCLPESFSLSVLHPEHGILWLNLDMRHAGAVSGKDTVRIHIEEREIVRFR

SEQ ID NO: 40690 - DNA, 939 bp, Neisseria meningitidis
  misc_feature (390)..(390): n is a, c, g, or t
atgcttgaactgaacggactctgcaaacgcttcggcggcaaaacggttgccgacgatatctgcctgactgtcgggcgcggcaaaatactcgccgttttggggcggtcgggctgcggcaaatccaccctgctgaatatgattgcgggcatcgtccggccggacggcggggaaatatggctgaatggggaaaacattacccgtatgccgcccgaaaaacgccgtatttcgctgatgtttcaagattacgcgctgtttccccatatgagtgcactggaaaatgcggcattcggtttgaaaatgcaaaaaatgccgaaagccgaagccgaaagcctcgccatggcggcacttgccgaagtcggactggaaaacgaggcgcaccgcaagcctganaaactttccggaggcgaaaagcaacggttggcactggcgcgcgctttggttgtccgcccttccctgctgctgttggacgaatcgttttccagtttggacacgcatttgcgcgaccggctgcgccgcatgactgccgaacgtatccgcaagggcggcatccctgccgttttggtaacgcattcgcccgaagaggcctgcacggcggcagacgaaatcgccgtcatgcacgaggggaaaatccttcaatgcggtacgcccgaaaccttggttcaaacgcctgccggcgtgcaggtcgcccatctgatggggctgcccaataccgacgatgaccgccatattccgcaacatgcggtgcgtttcgaccaagacggcatggagtgccgcgtattatcccgtacctgtttgcccgaatcgttcagcctgtccgtcctccatccggaacacggcatcctgtggctgaacctcgatatgccgcacgccggtgaaatatcgggaaacgatacggtacgcatccatatcgaagacagggaaatcgtccgcttccgctga

SEQ ID NO: 40691 - protein, 312 aa, Neisseria meningitidis
  misc_feature (130)..(130): Xaa can be any naturally occurring amino acid
MLELNGLCKRFGGKTVADDICLTVGRGKILAVLGRSGCGKSTLLNMIAGIVRPDGGEIWLNGENITRMPPEKRRISLMFQDYALFPHMSALENAAFGLKMQKMPKAEAESLAMAALAEVGLENEAHRKPXKLSGGEKQRLALARALVVRPSLLLLDESFSSLDTHLRDRLRRMTAERIRKGGIPAVLVTHSPEEACTAADEIAVMHEGKILQCGTPETLVQTPAGVQVAHLMGLPNTDDDRHIPQHAVRFDQDGMECRVLSRTCLPESFSLSVLHPEHGILWLNLDMPHAGEISGNDTVRIHIEDREIVRFR

SEQ ID NO: 40692 - DNA, 477 bp, Neisseria gonorrhoeae
atgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcagctgacccgcttcgattttactgacatccacctcgacggcagcaccggaggccttggctttttccgaagggaaaaaactggccacaaacggcgttgccacacccaatgctgccactccgcccgcgccgcaggtcgcaagtgtcaggaaacggcggcggccgttgttgatttcttgattatccattattcagtcgtcctaatattttgggaatgccgagccattaaacattgcaattttacccagtttgcagtgatactcaaagcattatttaaaataaggtaa

SEQ ID NO: 40693 - protein, 158 aa, Neisseria gonorrhoeae
MGADTDGDKDVRLNRTGLVFSILRLLFRIGIGIGKFAVQAFQVFKLLICTVEHPNRFALPLGGQQLTRFDFTDIHLDGSTGGLGFFRREKTGHKRRCHTQCCHSARAAGRKCQETAAAVVDFLIIHYSVVLIFWECRAIKHCNFTQFAVILKALFKIR

SEQ ID NO: 40694 - DNA, 477 bp, Neisseria meningitidis
atgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcagctgacccgcttcgattttactgacatccacctcgacggcagcaccggcggccttggctttttccgaagggaaaaaactggccacaaacggcgttgccacacccaatgctgccactccgcccgcgccgcaggtcgcgagtgtcaggaaacggcggcggccgttgttgatttcttgattatccattattcagtcgtcctaatattttgggaataccgagccattaaacgttgcaattttacccagtttgcagtgatactcaaagcattatttaaaataaggtaa

SEQ ID NO: 40695 - protein, 158 aa, Neisseria meningitidis
MGADTDGDKDVRLNRTGLVFSILRLLFRIGIGIGKFAVQAFQVFKLLICTVEHPNRFALPLGGQQLTRFDFTDIHLDGSTGGLGFFRREKTGHKRRCHTQCCHSARAAGRECQETAAAVVDFLIIHYSVVLIFWEYRAIKRCNFTQFAVILKALFKIR

SEQ ID NO: 40696 - DNA, 477 bp, Neisseria meningitidis
atgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcaactgacccgcttcgattttactgacatccacctcgacggcagcaccggcggccttggctttttccgaagggaaaaaactggccacaaacggcgttgccacacccaatgctgccactccgcccgcgccgcaggtcgcgagtgtcaggaaacggcggcggccgttgttgatttcttgattatccattattcagtcgtcctaatattttgggaataccgagccattaaacgttgcaattttacccagtttgcagtgatactcaaagcattatttaaaataaggtaa

SEQ ID NO: 40697 - protein, 158 aa, Neisseria meningitidis; identical to SEQ ID NO: 40695

SEQ ID NO: 40698 - DNA, 1167 bp, Neisseria gonorrhoeae
atgagaaaattcaatttgaccgcattgtccgtgatgcttgccttgggtttgaccgcgtgccagccgccggaggcggagaaagccgcgccggccgcgtccggtgagacccaatccgccaacgaaggcggttcggtcggtatcgccgtcaacgacaatgcctgcgaaccgatgaatctgaccgtgccgagcggacaggttgtgttcaatattaaaaacaacagcggccgcaagctcgaatgggaaatcctgaagggcgtgatggtggtggacgaacgcgaaaatatcgccccggggctttccgacaaaatgaaccgtaacctgctgccgggcgaatacgaaatgacctgcggccttttgaccaatccgcgcggcaagctggtggtagccgacagcggctttaaagacaccgccaacgaagcggatttggaaaaactgccccaaccgctcgccgactataaagcctacgttcaaggcgaggttaaagagctggcggcgaaaaccaaaacctttaccgaagccgtcaaagcaggcgacattgaaaaggcgaaatccctgtttgccgccacccgcgtccattacgaacgcatcgaaccgattgccgagcttttcagcgaactcgaccccgtcatcgatgcgtgtgaagacgacttcaaagacggtgcgaaagatgccgggtttaccggcttccaccgtatcgaacacgccctttgggtggaaaaagacgtatccggcgtgaaggaaaccgcggccaaactgatgaccgatgtcgaagccctgcaaaaagaaatcgacgcattggcgttccctccgggcaaagtggtcggcggcgcgtccgaactgattgaagaagcggcgggcagtaaaatcagcggcgaagaagaccgttacagccacaccgatttgagcgacttccaagctaatgcggacggatctaaaaaaatcgtcgatttgttccgtccgttgattgaggccaaaaacaaagccttgttggaaaaaaccgataccaacttcaaacaggtcaacgaaattctggcgaaataccgcaccaaagacggttttgaaacctacgacaagctgagcgaagccgaccgcaaagcattacaggctcctattaacgcgcttgccgaagaccttgcccaacttcgcggcatactcggcttgaaataa

SEQ ID NO: 40699 - protein, 388 aa, Neisseria gonorrhoeae
MRKFNLTALSVMLALGLTACQPPEAEKAAPAASGETQSANEGGSVGIAVNDNACEPMNLTVPSGQVVFNIKNNSGRKLEWEILKGVMVVDERENIAPGLSDKMNRNLLPGEYEMTCGLLTNPRGKLVVADSGFKDTANEADLEKLPQPLADYKAYVQGEVKELAAKTKTFTEAVKAGDIEKAKSLFAATRVHYERIEPIAELFSELDPVIDACEDDFKDGAKDAGFTGFHRIEHALWVEKDVSGVKETAAKLMTDVEALQKEIDALAFPPGKVVGGASELIEEAAGSKISGEEDRYSHTDLSDFQANADGSKKIVDLFRPLIEAKNKALLEKTDTNFKQVNEILAKYRTKDGFETYDKLSEADRKALQAPINALAEDLAQLRGILGLK

SEQ ID NO: 40700 - DNA, 1167 bp, Neisseria meningitidis
atgagaaaattcaatttgaccgcattgtccgtgatgcttgccttaggtttgaccgcgtgccagccgccggaggcggagaaagctgcgccggcagcgtccggtgaggcgcaaaccgccaacgagggcggttcggtcagtatcgccgtcaacgacaatgcctgcgaaccgatggaactgaccgtgccgagcggacaggttgtgttcaatattaaaaacaacagcggccgcaagctcgaatgggaaatcctgaaaggcgtgatggtggtggacgagcgcgaaaacatcgcccccggactttccgataaaatgaccgtcaccctgttgccgggcgaatacgaaatgacttgcggtcttttgaccaatccgcgcggcaagctggtggtaaccgacagcggctttaaagacaccgccaacgaagcggatttggaaaaactgtcccaaccgctcgccgactataaagcctacgttcaaggcgaggttaaagagctggtggcgaaaaccaaaacttttaccgaagccgtcaaagcaggcgacattgaaaaggcgaaatccctgtttgccgacacccgcgtccattacgaacgcatcgaaccgattgccgagcttttcagcgaactcgaccccgtcatcgatgcgcgtgaagacgacttcaaagacggcgcgaaagatgccggatttaccggctttcaccgtatcgaatacgccctttgggtggaaaaagacgtgtccggcgtgaaggaaattgcagcgaaactgatgaccgatgtcgaagccctgcaaaaagaaatcgacgcattggcgtttcctccgggcaaggtggtcggcggcgcgtccgaactgattgaagaagtggcgggcagtaaaatcagcggcgaagaagaccggtacagccacaccgatttgagcgacttccaagccaatgtggacggatctaaaaaaatcgtcgatttgttccgtccgctgatcgaggccaaaaacaaagccttgttggaaaaaaccgataccaacttcaaacaggtcaacgaaattctggcgaaataccggactaaagacggttttgaaacctacgacaagctgggcgaagccgaccgcaaagcgttacaggcctctattaacgcgcttgccgaagaccttgcccaacttcgcggcatactcggcttgaaataa

SEQ ID NO: 40701 - protein, 388 aa, Neisseria meningitidis
MRKFNLTALSVMLALGLTACQPPEAEKAAPAASGEAQTANEGGSVSIAVNDNACEPMELTVPSGQVVFNIKNNSGRKLEWEILKGVMVVDERENIAPGLSDKMTVTLLPGEYEMTCGLLTNPRGKLVVTDSGFKDTANEADLEKLSQPLADYKAYVQGEVKELVAKTKTFTEAVKAGDIEKAKSLFADTRVHYERIEPIAELFSELDPVIDAREDDFKDGAKDAGFTGFHRIEYALWVEKDVSGVKEIAAKLMTDVEALQKEIDALAFPPGKVVGGASELIEEVAGSKISGEEDRYSHTDLSDFQANVDGSKKIVDLFRPLIEAKNKALLEKTDTNFKQVNEILAKYRTKDGFETYDKLGEADRKALQASINALAEDLAQLRGILGLK

SEQ ID NO: 40702 - DNA, 1167 bp, Neisseria meningitidis
atgagaaaattcaatttgaccgcattgtccgtgatgcttgccttaggtttgaccgcgtgccagccgccggaggcggagaaagctgcgccggcagcgtccggtgaggcgcaaaccgccaacgagggcggttcggtcagtatcgccgtcaacgacaatgcctgcgaaccgatggaactgaccgtgccgagcggacaggttgtgttcaatattaaaaacaacagcggccgcaagctcgaatgggaaatcctgaaaggcgtgatggtggtggacgagcgcgaaaacatcgcccccggactttccgataaaatgaccgtcaccctgttgccgggcgaatacgaaatgacttgcggtcttttgaccaatccgcgcggcaagctggtggtaaccgacagcggctttaaagacaccgccaacgaagcggatttggaaaaactgtcccaaccgctcgccgactataaagcctatgttcaaggcgaagtcaaagagctggtggcgaaaaccaaaacctttaccgaagccgtcaaagcaggcgacattgaaaaggcgaaatccctgtttgccgacacccgcgtccattacgaacgcatcgaaccgattgccgagcttttcagcgaactcgaccccgtcatcgatgcgcgtgaagacgacttcaaagacggcgcgaaagatgccggatttaccggcttccaccgtatcgaatacgccctttgggtggaaaaagacgtgtccggcgtgaaggaaattgcagcgaaactgatgaccgatgtcgaagccctgcaaaaagaaatcgacgcattggcgtttcctccgggcaaggtggtcggcggcgcgtccgaactgattgaagaagtggcgggcagtaaaatcagcggcgaagaagaccggtacagccacaccgatttgagcgacttccaagccaatgtggacggatcgaaaaaaatcgtcgatttgttccgtccgttgatcgagaccaaaaacaaagccttgttggaaaaaaccgataccaacttcaaacaggtcaacgaaattctggcgaaataccggactaaagacggttttgaaacctacgacaagctgggcgaagccgaccgcaaagcgttacaggcctctattaacgcgcttgccgaagaccttgcccaacttcgcggcatactcggcttgaaataa

SEQ ID NO: 40703 - protein, 388 aa, Neisseria meningitidis; identical to SEQ ID NO: 24263

SEQ ID NO: 40704 - DNA, 1122 bp, Neisseria gonorrhoeae
atgctgctcttggacgagccgaccaaccacttggatgcggaatcggtggaatggctggagcaattcctcgtgcgcttccccggcacagtggtcgcggtaacgcacgaccgctacttcctcgacaacgccgccgaatggattttggaactcgaccgcggacacggcattccgtggaaaggcaattactcgtcttggctggagcagaaagaaaaacgcttggaaaacgaggcgaaatccgaagccgcgcgcgtgaaggcgatgaagcaggaattggaatgggtgcgccaaaatgccaaaggccgccaagccaagcccaaagcgcgtttggcgcgttttgaagaaatgagcaactacgaataccaaaaacgcaacgaaactcaggaaatctttatccctgttgccgagcgtttgggtaacgaagtgattgaatttgtgaatgtttccaaatcgttcggcgataaagtgctgattgacggtttgagcttcaaagtgccggcgggcgcgattgtcggcatcatcggcccgaacggcgcgggtaaatcgacgctgttcaaaatgattgcgggcaaagagcagcccgattcgggcgaagtgaaaatcgggcaaaccgtgaaaatgagcttgattgaccaaagccgcgaaggtttgcaaaacgacaaaaccgtgttcgacaacattgccgaaggtcgcgatattttgcaggtcggacagtttgaaatccccgcccgccaatatttgggacgcttcaactttaaaggcagcgaccaaagcaaaatcgcaaggcagctttccggcggcgaacgcggccgtctgcacttggcaaaaaccttgttgggcggcggcaatgtgttgctgctggacgaaccgtccaacgatctcgacgtggaaaccctgcgcgcgttggaagacgcattgttggaatttgccggcagcgtgatggtgatttcgcacgaccgctggtttctcgaccgcatagccacgcatatcttggcgtgtgaaggcgactccaaatgggtgttcttcgacggcaactatcaagaatacgaagccgacaagaaacgccgactcggcaaagaaggcgcgaaaccgaaacgcatcaaatacaaaccggtaacgcgttaa

SEQ ID NO: 40705 - protein, 373 aa, Neisseria gonorrhoeae
MLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKPKARLARFEEMSNYEYQKRNETQEIFIPVAERLGNEVIEFVNVSKSFGDKVLIDGLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKIARQLSGGERGRLHLAKTLLGGGNVLLLDEPSNDLDVETLRALEDALLEFAGSVMVISHDRWFLDRIATHILACEGDSKWVFFDGNYQEYEADKKRRLGKEGAKPKRIKYKPVTR

SEQ ID NO: 40706 - DNA, 3354 bp, Neisseria meningitidis
atgtcccaacaatacgtctattctatgctgcgcgtgagcaaggttgtgccgccgcagaaaaccatcattaaagatatttccctttctttcttccccggcgcgaaaatcggcctgctcggtttgaacggcgcgggcaagtccaccgtgctgcggattatggcgggcgtggataaggaatttgagggcgaagccgtgccgatgggcggcatcaaaatcggctacctgccgcaagagcctgagcttgatccggaaaaaaccgtgcgcgaggaagtggaaagcggtttgggcgaagtggctgccgcgcagaaacgtttggaagaagtgtatgccgagtacgccaatcctgatgcggattttgacgcgttggcagaagagcagggccgcttggaagcgattattgcggcaggttcgtccacgggcggcggtgcggaacacgaattggaaatcgccgccgacgcgctgcgcctgccggaatgggatgccaaaatcgataatttgtccggcggtgaaaaacgccgcgttgccttgtgcaaactcttgttgagcaagcccgatatgcttttgctggacgagccgaccaaccacttggatgcggaatcggtcgagtggctggagcaatttctcgtgcgcttccccggcacagtcgttgcggtaacgcacgaccgctacttcctcgacaacgccgccgaatggattttggaactcgaccgcggccatggtattccgtggaaaggcaattactcgtcttggctggagcagaaagaaaaacgcttggaaaacgaggcaaaatccgaagccgcgcgcgtgaaggcgatgaagcaggaattggaatgggtgcgccaaaatgccaaaggccgccaagccaagtccaaagcgcgtttggctcgttttgaagaaatgagcaactacgaataccaaaaacgcaatgaaacgcaggaaatctttattcccgttgccgagcgtttgggtaacgaagtgattgaatttgtaaatgtttccaaatcgttcggcgataaagtgctgattgacgatttgagcttcaaagtgcctgcgggcgcgattgtcggcatcatcggcccgaacggcgcgggtaaatctacgctgttcaaaatgatttcgggcaaagagcagcctgattccggcgaggtgaaaatcggacaaaccgtgaaaatgagcttgattgaccaaagccgcgaaggtttgcaaaacgacaaaaccgtgttcgacaacattgccgaaggccgcgacattttgcaggttggtcagtttgaaattcccgcccgccaatatttggggcgtttcaacttcaaaggcagcgaccaaagcaaaattgcaggtcaattgtctggcggcgaacgcggtcgtctgcacttggcaaaaaccttgttgagcggcggcaatgtattgctgctggatgaaccgtctaacgaccttgacgtggaaaccctgcgcgcgttggaagacgcattgttggaatttgccggcagcgtgatggtgatttcgcacgaccgttggttcctcgaccgcatcgccacgcatatcttggcgtgtgaaggcgactctaaatgggtgttcttcgacggcaactatcaggaatacgaagccgacaagaaacgccgtttgggcgaagaaggcgcgaaaccgaaacgcatcaaatacaaaccggtaacgcgttaaatgtcccaacaatacgtctattctatgctgcgcgtgagcaaggttgtgccgccgcagaaaaccatcattaaagatatttccctttctttcttccccggcgcgaaaatcggcctgctcggtttgaacggcgcgggcaagtccaccgtgctgcggattatggcgggcgtggataaggaatttgagggcgaagccgtgccgatgggcggcatcaaaatcggctacctgccgcaagagcctgagcttgatccggaaaaaaccgtgcgcgaggaagtggaaagcggtttgggcgaagtggctgccgcgcagaaacgtttggaagaagtgtatgccgagtacgccaatcctgatgcggattttgacgcgttggcagaagagcagggccgcttggaagcgattattgcggcaggttcgtccacgggcggcggtgcggaacacgaattggaaatcgccgccgacgcgctgcgcctgccggaatgggatgccaaaatcgataatttgtccggcggtgaaaaacgccgcgttgccttgtgcaaactcttgttgagcaagcccgatatgcttttgctggacgagccgaccaaccacttggatgcggaatcggtcgagtggctggagcaatttctcgtgcgcttccccggcacagtcgttgcggtaacgcacgaccgctacttcctcgacaacgccgccgaatggattttggaactcgaccgcggccatggtattccgtggaaaggcaattactcgtcttggctggagcagaaagaaaaacgcttggaaaacgaggcaaaatccgaagccgcgcgcgtgaaggcgatgaagcaggaattggaatgggtgcgccaaaatgccaaaggccgccaagccaagtccaaagcgcgtttggctcgttttgaagaaatgagcaactacgaataccaaaaacgcaatgaaacgcaggaaatctttattcccgttgccgagcgtttgggtaacgaagtgattgaatttgtaaatgtttccaaatcgttcggcgataaagtgctgattgacgatttgagcttcaaagtgcctgcgggcgcgattgtcggcatcatcggcccgaacggcgcgggtaaatctacgctgttcaaaatgatttcgggcaaagagcagcctgattccggcgaggtgaaaatcggacaaaccgtgaaaatgagcttgattgaccaaagccgcgaaggtttgcaaaacgacaaaaccgtgttcgacaacattgccgaaggccgcgacattttgcaggttggtcagtttgaaattcccgcccgccaatatttggggcgtttcaacttcaaaggcagcgaccaaagcaaaattgcaggtcaattgtctggcggcgaacgcggtcgtctgcacttggcaaaaaccttgttgagcggcggcaatgtattgctgctggatgaaccgtctaacgaccttgacgtggaaaccctgcgcgcgttggaagacgcattgttggaatttgccggcagcgtgatggtgatttcgcacgaccgttggttcctcgaccgcatcgccacgcatatcttggcgtgtgaaggcgactctaaatgggtgttcttcgacggcaactatcaggaatacgaagccgacaagaaacgccgtttgggcgaagaaggcgcgaaaccgaaacgcatcaaatacaaaccggtaacgcgttaa

SEQ ID NO: 40707 - protein, 558 aa, Neisseria meningitidis
MSQQYVYSMLRVSKVVPPQKTIIKDISLSFFPGAKIGLLGLNGAGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPEWDAKIDNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKSKARLARFEEMSNYEYQKRNETQEIFIPVAERLGNEVIEFVNVSKSFGDKVLIDDLSFKVPAGAIVGIIGPNGAGKSTLFKMISGKEQPDSGEVKIGQTVKMSLIDQSREGLQNDKTVFDNIAEGRDILQVGQFEIPARQYLGRFNFKGSDQSKIAGQLSGGERGRLHLAKTLLSGGNVLLLDEPSNDLDVETLRALEDALLEFAGSVMVISHDRWFLDRIATHILACEGDSKWVFFDGNYQEYEADKKRRLGEEGAKPKRIKYKPVTR

SEQ ID NO: 40708 - DNA, 1677 bp, Neisseria meningitidis
atgtcccaacaatacgtctattctatgctgcgcgtgagcaaggttgtgccgccgcagaaaaccatcattaaagatatttccctttctttcttccccggcgcgaaaatcggtttgctcggtttgaacggcgcgggcaagtccaccgtgctgcggattatggcgggcgtggataaagaatttgagggcgaagccgtgccgatgggcggtattaaaatcggctacctgccgcaagagcctgagcttgatccggaaaaaaccgtgcgtgaggaagtggaaagcggtttgggcgaagtggctgccgcgcagaaacgtttggaggaagtgtatgccgagtacgccaatcccgatgcggattttgacgcgttggcggaagagcaggggcgtttggaagcgattattgcggcgggttcgtccacgggcggcggtgcggaacacgaattggaaatcgctgccgacgcgctgcgcctgccggaatgggatgccaaaatcgataatttgtccggcggtgaaaaacgccgcgtcgctttgtgcaaactcttgttgagcaagcccgatatgcttttgctggacgagccgaccaaccacttggatgcggaatcggtcgagtggctggagcaatttctcgtgcgcttccccggtacagtcgttgccgtaacacacgaccgctacttcctcgacaacgccgccgaatggattttggaactcgaccgcgggcacggtattccgtggaaaggaaattactcgtcttggttggagcagaaagaaaaacgtttggaaaacgaggcgaaatccgaagccgcgcgcgtgaaagcgatgaagcaggaattggaatgggtgcgccaaaatgccaaaggccgtcaagccaagtccaaagcgcgtttggcgcgttttgaagaaatgagcaactatgaataccaaaaacgcaatgaaacgcaggaaatcttcattcccgtcgccgagcgtttgggtaacgaagtgattgaatttgtgaatgtttccaaatcgttcggcgacaaagtgctgattgacgatttgagcttcaaagtgcctgcgggcgcgattgtcggcatcatcggtccgaacggcgcgggtaaatcgacactgtttaaaatgattgcgggcaaagagcagcccgattccggtgaagtgaaaatcgggcaaaccgtgaaaatgagcttgattgaccaaagccgcgaaggtttgcaaaacgacaaaaccgtgttcgacaacattgccgaaggtcgcgatattttacaggtcgggcagtttgaaatccccgcccgccaatatttgggacgcttcaatttcaaaggcagcgaccaaagcaaaatcacggggcagctttccggcggcgaacgcggacgtttgcacttggcaaaaaccttgttgggcggtggcaatgtgttgctgctggacgaaccgtccaacgacctcgacgtggaaaccctgcgcgcgttggaagacgcattgctggaatttgccggcagcgtgatggtgatttcgcacgaccgctggttcctcgaccgtattgctacgcatatcttggcttgcgaaggcgactccaaatgggtgttctttgacggcaactatcaggaatacgaagccgacaagaaacgccgactcggcgaagaaggcacgaaaccgaaacgcatcaaatacaaaccggtaacgcgttaa

SEQ ID NO: 40709 - protein, 558 aa, Neisseria meningitidis
MSQQYVYSMLRVSKVVPPQKTIIKDISLSFFPGAKIGLLGLNGAGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPEWDAKIDNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKSKARLARFEEMSNYEYQKRNETQEIFIPVAERLGNEVIEFVNVSKSFGDKVLIDDLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKITGQLSGGERGRLHLAKTLLGGGNVLLLDEPSNDLDVETLRALEDALLEFAGSVMVISHDRWFLDRIATHILACEGDSKWVFFDGNYQEYEADKKRRLGEEGTKPKRIKYKPVTR

SEQ ID NO: 40710 - DNA, 1170 bp, Neisseria gonorrhoeae
atgctgcttcatgtcagcaattccctcaaacagcttcaggaagagcgtatccgccaagaacgtatccgccaagagcgtatccgtcaggcgcgcggcaaccttgcttccgtcaaccgcaaacagcgcgaggcttgggacaaattccaaaaactcaataccgagctgaaccgtttgaaaacggaagtcgccgctacgaaagcgcagatttcccgtttcgtatcggggaactataaaaacagccggccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatccctgctgaaaaaacagggtgtaaccgatgcggcggaacagacggaaagccgcagacagaatgccaaaatctccaaagatgcccgaaaactgctggaacagaaagggaacgagcagcagctgaacaagctcttgagcaatttggagaaaaaaaaagccgaacaccgcattcaggatgcggaagcaaaaagaaaattggctgaagccaaactggcggcagccgaaaaagccagaaaagaagcggcgcagcagaaggctgaagcgcgacgtgcggaaatgtccaacctgaccgccgaagacaggaacatccaagcgccttcggttatgggtatcggcagtgccgacggtttcagccgcatgcagggacgtttgaaaaaaccggttgacggtgtgccgaccgggcttttcgggcagaaccggagcggcggcgatgtttggaaaggcgtgttctattccactgcgcctgcaacggttgaaagcattgcgccgggaacggtaagctatgcggacgagttggacggctacggcaaagtggtcgtgatcgatcacggcgagaactacatcagcatctatgccggtttgagcgaaatttccgccggcaagggttatacggtcgcggcaggaagcaaaatcggcacgagcgggtcgctgccggacggggaagaggggctttacctgcaaatacgttatcgaggtcaggtgttgaacccttcgggctggatacgttga

SEQ ID NO: 40711 - protein, 389 aa, Neisseria gonorrhoeae
MLLHVSNSLKQLQEERIRQERIRQERIRQARGNLASVNRKQREAWDKFQKLNTELNRLKTEVAATKAQISRFVSGNYKNSRPNAVALFLKNAEPGQKNRFLRYTRYVNASNREVVKDLEKQQKALAVQEQKINNELARLKKIQANVQSLLKKQGVTDAAEQTESRRQNAKISKDARKLLEQKGNEQQLNKLLSNLEKKKAEHRIQDAEAKRKLAEAKLAAAEKARKEAAQQKAEARRAEMSNLTAEDRNIQAPSVMGIGSADGFSRMQGRLKKPVDGVPTGLFGQNRSGGDVWKGVFYSTAPATVESIAPGTVSYADELDGYGKVVVIDHGENYISIYAGLSEISAGKGYTVAAGSKIGTSGSLPDGEEGLYLQIRYRGQVLNPSGWIR

SEQ ID NO: 40712 - DNA, 1155 bp, Neisseria meningitidis
atgctgcttcatgtcagcaattccctcaaacagcttcaggaagagcgtatccgccaagagcgtatccgtcaggcgcgcggcaaccttgcttccgtcaaccgcaaacagcgcgaggcttgggacaagttccaaaaactcaataccgagctgaaccgtttgaaaacggaagtcgccgctacgaaagcgcagatttcccgtttcgtatcggggaactataaaaacagccagccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatctctgctgaaaaaacagggtgtaaccgatgcggcggaacagacggaaagccgcagacagaatgccaaaatcgccaaagatgcccgaaaactgctggaacagaaagggaacgagcagcagctgaacaagctcttgagcaatttggagaagaaaaaggccgaacaccgcattcaggatgcggaagcaaaaagaaaattggctgaagccagactggcggcagccgaaaaagccagaaaagaagcggcgcagcagaaggctgaagcacgacgtgcggaaatgtccaacctgaccgccgaagacaggaacatccaagcgccttcggttatgggtatcggcagtgccgacggtttcagccgcatgcaaggacgtttgaaaaaaccggttgacggtgtgccgaccggacttttcgggcagaaccggagcggcggcgatatttggaaaggcgtgttctattccactgcaccggcaacggttgaaagcattgcgccgggaacggtaagctatgcggacgagttggacggctacggcaaagtggtcgtggtcgatcacggcgagaactacatcagcatctatgccggtttgagcgaaatttccgtcggcaagggttatatggtcgcggcaggaagcaaaatcggctcgagcgggtcgctgccggacggggaagaggggctttacctgcaaatacgttatcaaggtcaggtattgaacccttcgagctggatacgttga

SEQ ID NO: 40713 - protein, 384 aa, Neisseria meningitidis
MLLHVSNSLKQLQEERIRQERIRQARGNLASVNRKQREAWDKFQKLNTELNRLKTEVAATKAQISRFVSGNYKNSQPNAVALFLKNAEPGQKNRFLRYTRYVNASNREVVKDLEKQQKALAVQEQKINNELARLKKIQANVQSLLKKQGVTDAAEQTESRRQNAKIAKDARKLLEQKGNEQQLNKLLSNLEKKKAEHRIQDAEAKRKLAEARLAAAEKARKEAAQQKAEARRAEMSNLTAEDRNIQAPSVMGIGSADGFSRMQGRLKKPVDGVPTGLFGQNRSGGDIWKGVFYSTAPATVESIAPGTVSYADELDGYGKVVVVDHGENYISIYAGLSEISVGKGYMVAAGSKIGSSGSLPDGEEGLYLQIRYQGQVLNPSSWIR

SEQ ID NO: 40714 - DNA, 1170 bp, Neisseria meningitidis
atgctgcttcatgtcagcaattccctcaagcagcttcaggaagagcgtatccgccaagaacgtatccgccaagagcgtatccgtcaggcgcgcggcaaccttgcttccgtcaaccgcaaacagcgcgaggcttgggacaagttccaaaaactcaataccgagctgaaccgtttgaaaacggaagtcgccgctacgaaagcgcagatttcccgtttcgtatcggggaactataaaaacagccagccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatccctgctgaaaaaacagggtgtaaccgatgcggcggaacagacggaaagccgcagacagaatgccaaaatcgccaaagatgcccgaaaactgctggaacagaaagggaacgagcagcagctgaacaagctcttgagcaatttggagaagaaaaaggccgaacaccgcattcaggatgcggaagcaaaaagaaaattggctgaagccagactggcggcagccgaaaaagccagaaaagaagcggcgcagcagaaggctgaagcacgacgtgcggaaatgtccaacctgaccgccgaagacaggaacatccaagcgccttcggttatgggtatcggcagtgccgacggtttcagccgcatgcaaggacgtttgaaaaaaccggttgacggtgtgccgaccggacttttcgggcagaaccggagcggcggcgatgtttggaaaggcgtgttctattccactgcaccggcaacggttgaaagcattgcgccgggaacggtaagctatgcggacgagttggacggctacggcaaagtggtcgtggtcgatcacggcgagaactacatcagcatctatgccggtttgagcgaaatttccgtcggcaagggttatatggtcgcggcaggaagcaaaatcggctcgagcgggtcgctgccggacggggaagaggggctttacctgcaaatacgttatcaaggtcaggtattgaacccttcgagctggatacgttga

SEQ ID NO: 40715 - protein, 389 aa, Neisseria meningitidis
MLLHVSNSLKQLQEERIRQERIRQERIRQARGNLASVNRKQREAWDKFQKLNTELNRLKTEVAATKAQISRFVSGNYKNSQPNAVALFLKNAEPGQKNRFLRYTRYVNASNREVVKDLEKQQKALAVQEQKINNELARLKKIQANVQSLLKKQGVTDAAEQTESRRQNAKIAKDARKLLEQKGNEQQLNKLLSNLEKKKAEHRIQDAEAKRKLAEARLAAAEKARKEAAQQKAEARRAEMSNLTAEDRNIQAPSVMGIGSADGFSRMQGRLKKPVDGVPTGLFGQNRSGGDVWKGVFYSTAPATVESIAPGTVSYADELDGYGKVVVVDHGENYISIYAGLSEISVGKGYMVAAGSKIGSSGSLPDGEEGLYLQIRYQGQVLNPSSWIR

SEQ ID NO: 40716 - DNA, 612 bp, Neisseria gonorrhoeae
atgttcccaaccggcaatttggtcgacgaaattgatgtgccgaatataggtcgtctgaaagccacgctcatcaacgcgggcattccgaccgttttcctgaacgccgccgacttgggctacacgggcaaagagttgcaggacgacatcaacaacgatgccgccgcgctggaaaaatttgaaaccatccgcgcatatggcgcgctgaaaatgggtttgatcagcgacgtatccgaagccgccgcccgcgcgcgcacgccgaaacccgccttcgtcgcgcccgccgccgattacaccgcctccagcggcaaaaccgtaaacgccgccgacatcgatttgccggtacgcgccctgagcatgggcaaactgcaccacgctatgatgggcatcgcctcggtcgccatcgccgccgccgtgctcggtacgctggtcaaccttgccgcaggcggcggaacgcgtaaagaagtgcgcttcgggcatccgtcaggtacgctgcgtgtcggtgctgccgccgaatgtcaggacggacaatggacggccgccaaagcggtcatgagccgcagcgcacgcgtgattatggaaagttgggtgcgcgttcccgatgattgtttttga

SEQ ID NO: 40717 - protein, 203 aa, Neisseria gonorrhoeae
MFPTGNLVDEIDVPNIGRLKATLINAGIPTVFLNAADLGYTGKELQDDINNDAAALEKFETIRAYGALKMGLISDVSEAAARARTPKPAFVAPAADYTASSGKTVNAADIDLPVRALSMGKLHHAMMGIASVAIAAAVLGTLVNLAAGGGTRKEVRFGHPSGTLRVGAAAECQDGQWTAAKAVMSRSARVIMESWVRVPDDCF

SEQ ID NO: 40718 - DNA, 618 bp, Neisseria meningitidis
atgttcccaaccggcaatttggtcgatgaaattgatgtgccgaatataggccgtttgaaagccacgctcatcaacgcgggcattccgaccgttttcttgaatgccgccgacttgggctacacaggcaaagagttgcaagacgacatcaacaacgatgccgcggctttggaaaaattcgagaaaatccgcgcttacggtgcgctgaaaatgggtctgatcagcgacgtatccgaagctgccgctcgcgcgcacacgccgaaagtcgccttcgtcgcgcccgccgccgattacaccgcctccagtggcaaaaccgtgaacgccgccgacatcgatttgctggtacgcgccctgagcatgggcaaactgcaccacgcgatgatgggtaccgcctctgttgccattgcgaccgccgccgccgtacccggtacgctggtcaaccttgccgcaggcggcggaacgcgtaaagaagtgcgcttcgggcatccttccggcacattgcgcgtcggtgcagccgccgaatgtcaggacggacaatggacggccaccaaagcggtcatgagccgtagcgcacgcgtgatgatggaaggttgggtcagggtgcctgaggattgtttttaa

SEQ ID NO: 40719 - protein, 205 aa, Neisseria meningitidis
MFPTGNLVDEIDVPNIGRLKATLINAGIPTVFLNAADLGYTGKELQDDINNDAAALEKFEKIRAYGALKMGLISDVSEAAARAHTPKVAFVAPAADYTASSGKTVNAADIDLLVRALSMGKLHHAMMGTASVAIATAAAVPGTLVNLAAGGGTRKEVRFGHPSGTLRVGAAAECQDGQWTATKAVMSRSARVMMEGWVRVPEDCF

SEQ ID NO: 40720 - DNA, 618 bp, Neisseria meningitidis
atgttcccaaccggcaatttggtcgatgaaattgatgtgccgaatataggccgtttgaaagccacgctcatcaacgcgggcattccgaccgttttcctgaatgccgccgacttgggctacacgggcaaagagttgcaagacgacatcaacaacgatgccgcagctttggaaaaattcgagaaaatccgcgcttacggtgcgctgaaaatgggtctgatcagcgacgtatccgaagctgccgcccgcgcgcacacgccgaaagtcgccttcgtcgcgcccgccgccgattacaccgcctccagtggcaaaaccgtgaatgccgccgacatcgatttgctggtacgcgccctgagcatgggcaaattgcaccacgcgatgatgggtaccgcctctgttgccattgcgaccgccgccgccgtgcccggtacgctggtcaaccttgccgcaggcggcggaacgcgtaaagaagtgcgcttcgggcatccttccggcacattgcgcgtcggtgcagccgccgaatgtcaggacggacaatggacggccaccaaagcggttatgagccgcagcgcacgcgtgatgatggaaggttgggtcagggtgccggaagattgtttttaa

SEQ ID NO: 40721 - protein, 205 aa, Neisseria meningitidis; identical to SEQ ID NO: 40719

SEQ ID NO: 40722 - DNA, 348 bp, Neisseria gonorrhoeae
atgttgctccatcaatgcgacaaagcgcgacatatgcgtccctttctgctcggcgggcagataaaccgtcatcgtcaggcgagcaaccgtggattgtgttccttcggcggttttcagggtaatcgggaagcgcaggtctttaatgccgacctgattgatcggcaggttgcgcaaatctctgctggattgcacgtctgcaatggcgttcatgcgttgtttgtccttaatattcagataattattgagatgtgtgtattgtatggcaggcagatgccgtctgaaaaaacgctgtcggccgcctgcctgcaaatgcgagattatatcacttgcttttggcggctgcattga

SEQ ID NO: 40723 - protein, 115 aa, Neisseria gonorrhoeae
MLLHQCDKARHMRPFLLGGQINRHRQASNRGLCSFGGFQGNREAQVFNADLIDRQVAQISAGLHVCNGVHALFVLNIQIIIEMCVLYGRQMPSEKTLSAACLQMRDYITCFWRLH

SEQ ID NO: 40724 - DNA, 336 bp, Neisseria meningitidis
atgttgctccatcaatgcgacaaaacgcgacatatgcgtccccttctgctcagcaggcaggtaaaccgtcatggtcagacgggcaatggtggactggatgccttctgcagtttgcagggtaatcggaaagcgcaggtctttgataccgacctgattgatcggcagattgcgcaaatctcggctggattgcacgtctgcaatagtgttcatgagttgtttttccttaatattcatgtaattgttgagatgtgtgcatggtatggcgtttccgccggggaatataccgtcaatctgcaaatgcgagattatatcactcgcttttagcagctgcattga

SEQ ID NO: 40725 - protein, 110 aa, Neisseria meningitidis
MLLHQCDKTRHMRPLLLSRQVNRHGQTGNGGLDAFCSLQGNRKAQVFDTDLIDRQIAQISAGLHVCNSVHELFFLNIHVIVEMCAWYGVSAGEYTVNLQMRDYITRFQLH

SEQ ID NO: 40726 - DNA, 336 bp, Neisseria meningitidis
atgttgctccatcaatgcgacaaagcgcgacatatgcgtacccttctgctcggcaggcaggtaaaccgtcatggtcagacgggcaactgtggactggatgccttctgcagtttgcagggtaatcggaaagcgcaggtctttgataccgacctgattgatcggcagattgcgcaaatctcggctggattgcacgtctgcaatagtgttcatgagttgtttttccttaatattcatgtaattgttgagatgtgtgcatggtatggcgtttccaccggggaatataccgtcaatctgcaaatgcgagattatatcactcgcttttagcagctgcattga

SEQ ID NO: 40727 - protein, 110 aa, Neisseria meningitidis
MLLHQCDKARHMRTLLLGRQVNRHGQTGNCGLDAFCSLQGNRKAQVFDTDLIDRQIAQISAGLHVCNSVHELFFLNIHVIVEMCAWYGVSTGEYTVNLQMRDYITRFQLH

SEQ ID NO: 40728 - DNA, 1350 bp, Neisseria gonorrhoeae
atggattcccgcctgcgtgggaatgacgctaggaaatacggcatacgctttgcccaaagaggccgtctgaaacacactccgcccaacgcccatcctttttcagacggccccgcaccaaaaaaacaaccacaaactacaaggagaaacatcatgtccgaccaactcattcttgtcctgaactgcgtcagttcatcgctcaaaggcgccgttatcgaccgcaaaagcggcagcgtcgtcctaagctgcctcggggaacgcctgactacgcccgaagccgtcattaccttcaacaaagacggcaacaaacgccaagttcccctgagcggccgcaactgccacgccggcgcggtgggtatgctgttgaacgaactggaaaaacacggactgcacgaccgcatcaaagccatcggccgccgcatcgcccacggcggcgaaaaatatcacgagtccgtcctcatcgaccaagacgtccttgacgaactgaaagcctgcatcccgttcgccccgctgcacaaccccgccaacatcagcggcatcctcgccgcgcaggaacactttcccggcctgcccaacgtcggcgtgatggacacctcgttccaccaaaccatgccggagcgggcctacacttatgccgtgccgcgcgaattgcgcaaaaaatacgccttccgccgctacggtttccacggtaccggtatgcgttacgtcgcccctgaagccgcacgcatcttgggcaaacctctggaagacatccgcatgattattgcccacttaggcaacggcgcatctattaccgccgtcaaaaacggcaaatccgtcgataccggtatgggtttcacgccgatcgaaggtttggtaatgggtacacgttgcggcgacaccgatccgggcgtatacagctatccgactttccacgcagggatggatgttgcccaagttgatgaaatgctgaacgaaaaatcaggtttccccggtatttccgaacttcccaacgactgccgcaccctcgaaatcgccgccgacgaaggccgcgaaggcgcgcgcctcgccctcgaagtcatgacctgccgcctcgccaaatacatcgcttcgatggctgtggcctgcggcagtgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggtcgtcccgaccaatgaagaactgatgattgcctgcgacactgccgaacttgccggcatcttgtag

SEQ ID NO: 40729 - protein, 449 aa, Neisseria gonorrhoeae
MDSRLRGNDARKYGIRFAQRGRLKHTPPNAHPFSDGPAPKKQPQTTRRNIMSDQLILVLNCVSSSLKGAVIDRKSGSVVLSCLGERLTTPEAVITFNKDGNKRQVPLSGRNCHAGAVGMLLNELEKHGLHDRIKAIGRRIAHGGEKYHESVLIDQDVLDELKACIPFAPLHNPANISGILAAQEHFPGLPNVGVMDTSFHQTMPERAYTYAVPRELRKKYAFRRYGFHGTGMRYVAPEAARILGKPLEDIRMIIAHLGNGASITAVKNGKSVDTGMGFTPIEGLVMGTRCGDTDPGVYSYPTFHAGMDVAQVDEMLNEKSGFPGISELPNDCRTLEIAADEGREGARLALEVMTCRLAKYIASMAVACGSVDALVFTGGIGENSRNIRAKTVSYLDFLGLHIDTKANMEKRYGNSGIISPTDSSPAVLVVPTNEELMIACDTAELAGIL

SEQ ID NO: 40730 - DNA, 1352 bp, Neisseria meningitidis
ctgtcctcgcgtaggcggggacggaataacgatagaaaatgcggcatacgctttgcccaaagaggccgtctgaaacaccttgcgcctgatgtctgcctttttcagacgaccccacactaaaaaaacaaccacaaactacaaggagaaacatcatgtccgaccaactcatcctcgttctgaactgcggcagttcatcgctcaaaggcgccgttatcgaccgamaaagcggcagcgtcgtcctaagctgcctcggcgaacgcctgaccacgcccgaagccgtcattacgttcaacaaagacggcaacaaacgccaagttcccctgagcggccgaaattgccacgccggcgcggtgggtatgcttttgaacgaactggaaaaacacggtctgcacgaccgcatcaaagccatcggccaccgcatcgcccacggcggcgaaaaatacagcgagtctgttttgatcgaccaggccgtaatggacgaactcaatgcctgcattccgcttgcgccgctgcacaaccccgccaacatcagcggcatccttgccgcacaggaacatttccccggtctgcccaatgtcggcgtgatggatacttcgttccaccaaaccatgccggagcgtgcctacacttatgccgtgccgcgcgagttgcgtaaaaaatacgctttccgccgctacggtttccacggcaccagtatgcgttacgttgcccctgaagccgcacgcatcttgggcaaacctctggaagacatccgcatgattattgcccacttaggcaacggcgcatccattaccgccatcaaaaacggcaaatccgtcgataccagtatgggtttcacgccgatcgaaggtttggtaatgggtacacgttgcggcgacatcgatccgggcgtatacagctatctgacttcccacgccgggatggatgttgcccaagtggatgaaatgctgaacaaaaaatcaggtttgctcggtatttccgaactttccaacgactgccgcaccctcgaaatcgccgccgacgaaggccacgaaggcgcgcgcctcgccctcgaagtcatgacctaccgcctcgccaaatacatcgcttcgatggctgtgggctgcggcggcgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggttgtcccgaccaatgaagaactgatgattgcctgcgacactgccgaacttgccggcatcttgtag

SEQ ID NO: 40731 - protein, 450 aa, Neisseria meningitidis
  misc_feature (33)..(33): Xaa can be any naturally occurring amino acid
  misc_feature (75)..(75): Xaa can be any naturally occurring amino acid
LSSRRRGRNNDRKCGIRFAQRGRLKHLAPDVCXFSDDPTLKKQPQTTRRNIMSDQLILVLNCGSSSLKGAVIDRXSGSVVLSCLGERLTTPEAVITFNKDGNKRQVPLSGRNCHAGAVGMLLNELEKHGLHDRIKAIGHRIAHGGEKYSESVLIDQAVMDELNACIPLAPLHNPANISGILAAQEHFPGLPNVGVMDTSFHQTMPERAYTYAVPRELRKKYAFRRYGFHGTSMRYVAPEAARILGKPLEDIRMIIAHLGNGASITAIKNGKSVDTSMGFTPIEGLVMGTRCGDIDPGVYSYLTSHAGMDVAQVDEMLNKKSGLLGISELSNDCRTLEIAADEGHEGARLALEVMTYRLAKYIASMAVGCGGVDALVFTGGIGENSRNIRAKTVSYLDFLGLHIDTKANMEKRYGNSGIISPTDSSPAVLVVPTNEELMIACDTAELAGIL

SEQ ID NO: 40732 - DNA, 1352 bp, Neisseria meningitidis
ctgtcctcgcgtaggcggggacggaataacgatagaaaatgcggcatacgctttgcccaaagaggccgtctgaaacacactccgcccaacgcccatcctttttcagacgaccccacaccaaaaaacaaccacaaactacaaggagaaacatcatgtccgaccaactcattcttgttctgaactgcggcagttcatcgctcaaaggtgccgttatcgaccgcaaaagcggcagcgtcgtcctaagctgcctcggcgaacgcctgaccacgcccgaagccgtcattacgttcagcaaagacggcaacaaacgccaagttcccctgagcggccggaactgccacgccggcgcggtgggtatgctgttgaacgaactggaaaaacacgaactgcacgaccgcattcaagccgtcggccaccgcatcgcccacggcggcgaaaaatacagcgagtctgttttgatcgaccaggccgtaatggacgaactcaatgcctgcattccgcttgcgccgctgcacaaccccgccaacatcagcggcatcctcgccgcacaggaacatttccccggtctgcccaatgtcggcgtgatggatacttcgttccaccaaaccatgccggagcgtgcctacacttatgccgtgccgcgcgagttgcgtaaaaaatacgctttccgccgctacggtttccacggcaccagtatgcgttacgttgcccctgaagccgcatgcatcttgggcaaacctctggaagacatccgcatgattattgcccacttaggcaacggcgcatccattaccgccatcaaaaacggcaaatccgtcgataccagtatgggtttcacgccgatcgaaggtttggtaatgggtacgcgctgcggcgatatcgacccgggcgtatacagctatctgacttcacacgccggtttggatgttgcacaagttgatgaaatgctgaataaaaaatcaggcttgctcggtatttccgaactctccaacgactgccgcaccctcgaaatcgccgccgacgaaggccacgaaggcgcgcgcctcgccctcgaagttatgacctaccgcctcgccaaatacatcgcttcgatggctgtgggctgcggcggcgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggtattatcagcccgaccgattcttctccggctgttttggttgtcccgaccaatgaagaactgatgattgcctgcgacactgccgaacttgtcggcatcttgtag

SEQ ID NO: 40733 - protein, 450 aa, Neisseria meningitidis
  misc_feature (40)..(40): Xaa can be any naturally occurring amino acid
LSSRRRGRNNDRKCGIRFAQRGRLKHTPPNAHPFSDDPTXKKQPQTTRRNIMSDQLILVLNCGSSSLKGAVIDRKSGSVVLSCLGERLTTPEAVITFSKDGNKRQVPLSGRNCHAGAVGMLLNELEKHELHDRIQAVGHRIAHGGEKYSESVLIDQAVMDELNACIPLAPLHNPANISGILAAQEHFPGLPNVGVMDTSFHQTMPERAYTYAVPRELRKKYAFRRYGFHGTSMRYVAPEAACILGKPLEDIRMIIAHLGNGASITAIKNGKSVDTSMGFTPIEGLVMGTRCGDIDPGVYSYLTSHAGLDVAQVDEMLNKKSGLLGISELSNDCRTLEIAADEGHEGARLALEVMTYRLAKYIASMAVGCGGVDALVFTGGIGENSRNIRAKTVSYLDFLGLHIDTKANMEKRYGNSGIISPTDSSPAVLVVPTNEELMIACDTAELVGIL

SEQ ID NO: 40734 - DNA, 504 bp, Neisseria gonorrhoeae
atgcccgaagcgcacttctttacgcgttccgccgcctgcggcaaggttgaccagcgtaccgagcacggcggcggcgatggcgaccgaggcgatgcccatcatagcgtggtgcagtttgcccatgctcagggcgcgtaccggcaaatcgatgtcggcggcgtttacggttttgccgctggaggcggtgtaatcggcggcgggcgcgacgaaggcgggtttcggcgtgcgcgcgcgggcggcggcttcggatacgtcgctgatcaaacccattttcagcgcgccatatgcgcggatggtttcaaatttttccagcgcggcggcatcgttgttgatgtcgtcctgcaactctttgcccgtgtagcccaagtcggcggcgttcaggaaaacggtcggaatgcccgcgttgatgagcgtggctttcagacgacctatattcggcacatcaatttcgtcgaccaaattgccggttgggaacatactgccttcgccgtcggctggatctaa

SEQ ID NO: 40735 - protein, 167 aa, Neisseria gonorrhoeae
MPEAHFFTRSAACGKVDQRTEHGGGDGDRGDAHHSVVQFAHAQGAYRQIDVGGVYGFAAGGGVIGGGRDEGGFRRARAGGGFGYVADQTHFQRAICADGFKFFQRGGIVVDVVLQLFARVAQVGGVQENGRNARVDERGFQTTYIRHINFVDQIAGWEHTAFAVGWI

SEQ ID NO: 40736 - DNA, 507 bp, Neisseria meningitidis
atgcccgaagcgcacttctttacgcgttccgccgcctgcggcaaggttgaccagcgtaccgggtacggcggcggcggtcgcaatggcaacagaggcggtacccatcatcgcgtggtgcagtttgcccatgctcagggcgcgtaccagcaaatcgatgtcggcggcgttcacggttttgccactggaggcggtgtaatcggcggcgggcgcgacgaaggcgactttcggcgtgtgcgcgcgagcggcagcttcggatacgtcgctgatcagacccattttcagcgcaccgtaagcgcggattttctcgaatttttccaaagccgcggcatcgttgttgatgtcgtcttgcaactctttgcctgtgtagcccaagtcggcggcattcaagaaaacggtcggaatgcccgcgttgatgagcgtggctttcaaacggcctatattcggcacatcaatttcatcgaccaaattgccggttgggaacatactgccttcgccgtcggctggatc

SEQ ID NO: 40737 - protein, 169 aa, Neisseria meningitidis
MPEAHFFTRSAACGKVDQRTGYGGGGRNGNRGGTHHRVVQFAHAQGAYQQIDVGGVHGFATGGGVIGGGRDEGDFRRVRASGSFGYVADQTHFQRTVSADFLEFFQSRGIVVDVVLQLFACVAQVGGIQENGRNARVDERGFQTAYIRHINFIDQIAGWEHTAFAVGWI

SEQ ID NO: 40738 - DNA, 663 bp, Neisseria meningitidis
atgcccgaagcgcacttctttacgcgttccgccgcctgcggcaaggttgaccagcgtaccgggcacggcggcggcggtcgcaatggcaacagaggcggtacccatcatcgcgtggtgcaatttgcccatgctcagggcgcgtaccagcaaatcgatgtcggcggcattcacggttttgccactggaggcggtgtaatcggcggcgggcgcgacgaaggcgactttcggcgtgtgcgcgcgggcggcagcttcggatacgtcgctgatcagacccattttcagcgcaccgtaagcgcggattttctcgaatttttccaaagctgcggcatcgttgttgatgtcgtcttgcaactctttgcccgtgtagcccaagtcggcggcattcaggaaaacggtcggaatgcccgcgttgatgagcgtggctttcaaacggcctatattcggcacatcaatttcatcgaccaaattgccggttgggaacatactgccttcgccgtcggctggatcaagaaattcgatttgtacttcggctgccgggaacgttacgccgtcgagctcaaaatcgcctgtttccaaaactgcgccgttttgcatcggtacatgggcaataatggttttgccgatgtttttctgccagattttgactgtgcagatgccgtctga

SEQ ID NO: 40739 - protein, 220 aa, Neisseria meningitidis
MPEAHFFTRSAACGKVDQRTGHGGGGRNGNRGGTHHRVVQFAHAQGAYQQIDVGGIHGFATGGGVIGGGRDEGDFRRVRAGGSFGYVADQTHFQRTVSADFLEFFQSCGIVVDVVLQLFARVAQVGGIQENGRNARVDERGFQTAYIRHINFIDQIAGWEHTAFAVGWIKKFDLYFGCRERYAVELKIACFQNCAVLHRYMGNNGFADVFLPDFDCADAV

SEQ ID NO: 40740 - DNA, 1545 bp, Neisseria gonorrhoeae
atgatgaccgaaatgcaacaacgcgcccaactgcaccgccaaatttggaaaatcgccgacgaagtacgcggcgcggtggatggctgggactttaaacaatacgttctcggcacacttttctaccgctttatcagcgaaaacttcaccgactatatgcaggccggcgacagcagcattgattacgccgctatgccggacagcatcatcacgcccgaaatcaaagacgatgccgtcaaagtcaaaggctatttcatctaccccggccagcttttttgcaatattgccgccgaagcccatcaaaacgaagagctcaacaccaagctgaaagaaatctttaccgcgattgaaagctccgcctccggctacccgtccgaacaaggcatcaaaggcttgtttgacgacttcgacaccaccagcagccggctcggcagcaccgttgccgacaaaaacaaacgccttgccgccgtccttaaaggcgtggcggaactcgatttcggcaattttgaagaccaccgcatcgaccttttcggtgatgcctacgaatacctgatttccaactacgccgccaacgcaggcaaatccggcggcgaatttttcaccccgcaaagcgtctccaagctgattgcgcggctggcggtgcacgggcaggagaaagtcaacaaaatctacgaccccgcctgcggctcgggcagcctgctcttgcaggcgaaaaaacagtttgacgaacacatcatcgaagaaggcttcttcgggcaggaaatcaaccacaccacctacaacctcgcccgcatgaatatgtttctgcacaacgtcaattacaacaaattccacatcgaattgggcgacacgctgaccaaccccaaactcaaagacagcaaaccctttgatgccgtcgtctccaatccgccctattccatcgactggataggcagcgacgaccccaccttgatcaacgacgaccgctttgcccccgcaggcgtactcgcaccgaaatccaaagccgattttgccttcatcctgcacgcactgaactacctttccggcagaggccgcgccgctatcgtctcattccccggcattttctatcgcggcggcgcagagcagaaaatccgccaatatctggtggagggcaactatgtggaaaccgtgattgcccttgcgcccaatctcttttacggcacctgcatcgccgtcaatatcctggttttgtccaaacacaaagacaataccgacatccaattcatcgacgcaagcggcttctttaaaaaagaaaccaacaacaacgtcttaaccgaagaacacattgccgaaatcgtcaaactcttcgccgacaaagccgatgtgccgcatatcgcccaaaacgccgcccagcaaaccgtcaaagacaacggctacaacctcgccgtcagcagctatgtcgaagccgaagacacccgcgaggtcatcgacatcagacagctcaacgccgaaatcagcgaaaccgtcgccaaaatcgaacggctgcggcgtgaaattgacgaagtgattgcagagattgaaacctag

SEQ ID NO: 40741 - protein, 514 aa, Neisseria gonorrhoeae
MMTEMQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQGIKGLFDDFDTTSSRLGSTVADKNKRLAAVLKGVAELDFGNFEDHRIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNKFHIELGDTLTNPKLKDSKPFDAVVSNPPYSIDWIGSDDPTLINDDRFAPAGVLAPKSKADFAFILHALNYLSGRGRAAIVSFPGIFYRGGAEQKIRQYLVEGNYVETVIALAPNLFYGTCIAVNILVLSKHKDNTDIQFIDASGFFKKETNNNVLTEEHIAEIVKLFADKADVPHIAQNAAQQTVKDNGYNLAVSSYVEAEDTREVIDIRQLNAEISETVAKIERLRREIDEVIAEIET

SEQ ID NO: 40742 - DNA, 1545 bp, Neisseria meningitidis
atgatgaccgaaatgcaacaacgcgcccaactgcaccgccaaatttggaaaattgccgacgaagtacgcggcgcggtggatggctgggactttaaacaatacgttctcggcacacttttctaccgctttatcagcgaaaacttcaccgactatatgcaggcaggcgacagcagtattgattacgccgctatgccggacagcatcatcacgcccgaaatcaaagacgatgccgtcaaagttaaaggctatttcatctaccccggccagcttttttgcaatattgccgccgaagcccatcaaaacgaagagctcaacaccaagctgaaagaaatttttaccgcgattgaaagctccgcctccggctatccgtccgaacaggacatcaaaggcctgtttgacgacttcgacaccaccagcagccggctcggcagcactgttgccgacaagaacaaacgccttgccgccgtcctcaaaggcgtggcggaactcgatttcggcaattttgaaaaccaccacatcgaccttttcggcgatgcctacgaatacctgatttccaactacgctgccaacgcaggcaaatccggcggcgaatttttcaccccgcaaagcgtatccaagctgattgcgcggctggcggtgcacggacaggagaaagtcaacaaaatctacgacccagcttgcggctcgggcagtctgctcttgcaggcgaaaaaacagtttgacgagcacatcatcgaagaaggcttcttcgggcaggaaatcaaccacaccacctacaacctcgcccgcatgaacatgttcctgcacaacgtcaattacaaccaattccacatcgaattgggcgacacactgaccaacccaaagctcaaagacagcaaaccctttgatgccatcgtttccaatccgccttattccatcaactggataggcagcgacgaccccaccttaatcaacgacgaccgctttgcccccgcaggcgtacttgccccgaaatccaaagccgattttgccttcatcctgcacgcactgaactacctttccggcagaggccgcgccgccatcgtctcattccccggcattttctatcgcggcggcgcagaacagaaaatccgccaatatctggtggagggcaactacgtggaaaccgtgattgcccttgcgcccaatctcttttacggcaccggcatcgccgtcaatatcctggttttgtccaaacacaaagacaataccgacatccaattcatcgacgcaagcggcttctttaaaaaagaaaccaacaacaacgtcttaatcgaagaacacattgctgaaatcgtcaaactcttcgccgataaagccgatgtgccgcatatcgcccaaaacgctgcccagcaaaccgtcaaagacaacggctacaacctcgccgtcagcagctatgtcgaagccgaagacacacgcgaaattatcgacatcaaacagctcaacgccgaaatcggcgaaaccgtcgccaaaatcgaacggctgcggcgtgaaattgacgaagtgattgcagagattgaagcatga

SEQ ID NO: 40743 - protein, 514 aa, Neisseria meningitidis
MMTEMQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQDIKGLFDDFDTTSSRLGSTVADKNKRLAAVLKGVAELDFGNFENHHIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNQFHIELGDTLTNPKLKDSKPFDAIVSNPPYSINWIGSDDPTLINDDRFAPAGVLAPKSKADFAFILHALNYLSGRGRAAIVSFPGIFYRGGAEQKIRQYLVEGNYVETVIALAPNLFYGTGIAVNILVLSKHKDNTDIQFIDASGFFKKETNNNVLIEEHIAEIVKLFADKADVPHIAQNAAQQTVKDNGYNLAVSSYVEAEDTREIIDIKQLNAEIGETVAKIERLRREIDEVIAEIEA

SEQ ID NO: 40744 - DNA, 1545 bp, Neisseria meningitidis
atgatgaccgaaatacaacaacgcgcccaactgcaccgccaaatttggaaaattgccgacgaagtacgcggcgcggtggatggctgggacttcaaacaatacgttctcggcacacttttctaccgctttatcagcgaaaactttaccgactatatgcaggcaggcgacagcagtattgattacgccgctatgccggacagcatcatcacgcccgaaatcaaagacgatgccgtcaaagtcaaaggctatttcatctaccccggccagcttttttgcaatattgccgccgaagcccatcaaaacgaagagctcaacaccaagctgaaagaaatttttaccgcgattgaaagctccgcctccggctatccgtccgaacaagacattaaaggcctgtttgacgacttcgacaccaccagcagccggctcggcagcaccgttgccgacaagaacaaacgccttgccgccgtcctaaaaggcgtggcggaactcgatttcggcagttttgaagaccaccacatcgaccttttcggcgatgcctacgaatacctgatttccaactacgctgccaacgcaggcaaatccggcggcgaatttttcaccccgcaaagcgtatccaagctgattgcgcggctggcggtgcacgggcaggagaaagtaaacaaaatctacgacccagcttgcggctcgggcagcctgctcttgcaggcgaaaaaacagtttgacgagcacatcatcgaagaaggcttcttcgggcaggaaatcaaccacaccacctacaacctcgcccgcatgaatatgtttctgcacaacgtcaattacaacaaattccacatcgaattgggcgacacactgaccaatcccaaactcaaagacagcaaaccctttgatgccgtcgtttccaatccgccctattccatcaactggataggcagcggcgaccccaccttaatcaacgacgaccgctttgcccctgcaggcgtactcgccccgaaatccaaagccgattttgccttcattctgcacgcactgaactacctttccggcagaggccgcgccgccatcgtctcattccccggcattttctatcgcggcggcgcagagcagaaaatccgccaatatctggtggagggcaactacgtggaaaccgtcatcgcccttgcgcccaatctcttttacggcaccggcatcgccgtcaatatactggttttgtccaaacacaaagacaataccgacatccaattcatcgacgcaggcggcttctttaaaaaagaaaccaacaacaacgtcttaaccgaagaacacattgccgaaatcgtcaaactcttcgccgataaagccgatgtgccgcatatcgcccaaaacgccgcccagcaaaccgtcaaagacaacggctacaacctcgccgtcagcagctatgttgaacccgaagacacccgcgaaattatcgacatcaaacagcttaacgccgaaatcagcgaaaccgttgccaaaatcgaacggctgcggcgtgaaattgacgaagtgattgcagagattgaagcatga

SEQ ID NO: 40745 - protein, 514 aa, Neisseria meningitidis
MMTEIQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQDIKGLFDDFDTTSSRLGSTVADKNKRLAAVLKGVAELDFGSFEDHHIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNKFHIELGDTLTNPKLKDSKPFDAVVSNPPYSINWIGSGDPTLINDDRFAPAGVLAPKSKADFAFILHALNYLSGRGRAAIVSFPGIFYRGGAEQKIRQYLVEGNYVETVIALAPNLFYGTGIAVNILVLSKHKDNTDIQFIDAGGFFKKETNNNVLTEEHIAEIVKLFADKADVPHIAQNAAQQTVKDNGYNLAVSSYVEPEDTREIIDIKQLNAEISETVAKIERLRREIDEVIAEIEA

SEQ ID NO: 40746 - DNA, 681 bp, Neisseria gonorrhoeae
atgtccaaatttatcgccaaacaatcggtcggtgcggaagtcatcgacacgccgcgcaccgaagaagaagcctggcttctgaacactgtcgaagcccaagcgcggcaatggaatctgaaaacgccagaagtcgccatctaccactcccccgaacccaatgcctttgccacgggcgcatcgagaaacagctccctgatcgccgtcagcaccggtttgctcgaccatatgacgcgcgacgaagtggaagccgtgttggcgcacgaaatggcgcacgtcggcaacggcgacatggttacgctgacgctgattcaaggcgtggtcaatacctttgtcgtgttcctgtcgcgcattattgccaacctgattgcccgaaacaacgacggcagccagtcccagggaacttatttcctagtcagcatggtattccaaatcctgttcggcttccttgccagcctgattgtcatgtggttcagccgccaacgcgaataccgcgccgacgcgggcgcggcaaaactggtcggcgcaccgaaaatgatttccgccctgcaaaggcttaaaggcaacccggtcgatttgcccgaagaaatgaacgcaatgggcatcgccggagatacgcgcgactccctgctcagcacccacccttcgctggacaaccgaatcgcccgcctcaaatcgctttaa

SEQ ID NO: 40747 - protein, 226 aa, Neisseria gonorrhoeae
MSKFIAKQSVGAEVIDTPRTEEEAWLLNTVEAQARQWNLKTPEVAIYHSPEPNAFATGASRNSSLIAVSTGLLDHMTRDEVEAVLAHEMAHVGNGDMVTLTLIQGVVNTFVVFLSRIIANLIARNNDGSQSQGTYFLVSMVFQILFGFLASLIVMWFSRQREYRADAGAAKLVGAPKMISALQRLKGNPVDLPEEMNAMGIAGDTRDSLLSTHPSLDNRIARLKSL

SEQ ID NO: 40748 - DNA, 681 bp, Neisseria meningitidis
atgtccaaatttatcgccaaacaatcggtcggcgcggaagttatcgacacgccgcgcaccgaagaagaagcctggcttttgaacactgtcgaagcccaagcgcggcaatggaacctgaaaacgcccgaagtcgccatctaccactcccccgaacccaatgcctttgccacgggcgcatcgagaaacagctccctgatcgccgtcagcaccggtttgctcgaccatatgacgcgtgacgaagtggaagccgtattggcgcacgaaatggcacacgtcggcaacggcgatatggttacgctgacgctgattcaaggcgtggtcaatacctttgtcgtgttcctgtcgcgcattattgccaacctgattgcccgaaacaacgacggcagccagtcccagggaacttatttcctggtcagcatggtattccaaatcctgttcggcttccttgccagcttaattgtcatgtggttcagccgacaacgcgaataccgcgccgatgcgggcgcggcaaaactggtcggcgcgccgaaaatgatttccgccctgcaaaggctcaaaggcaacccggtcgatttgcccgaagaaatgaacgcaatgggcatcgccggagatacgcgcgactccctgctcagcacccacccttcgctggacaaccgtatcgcccgcctcaaatcgctttaa

SEQ ID NO: 40749 - protein, 226 aa, Neisseria meningitidis; identical to SEQ ID NO: 40747

SEQ ID NO: 40750 - DNA, 681 bp, Neisseria meningitidis
atgtccaaattcatcgccaaacaatcggtcggcgcggaagttatcgacacgccgcgcaccgaagaagaagcctggcttttgaacactgtcgaagcccaagcgcggcaatggaacctgaaaacgcccgaagtcgccatctaccactcccccgaacccaatgcctttgccacgggcgcatcgagaaacagctccctgatcgccgtcagcaccggtttgctcgaccatatgacgcgtgacgaagtggaagccgtattggcgcacgaaatggcacacgtcggcaacggcgatatggttacgctgacgctgattcaaggcgtggtcaatacctttgtcgtgttcctgtcgcgcattattgccaacctgattgcccgaaacaacgacggcagccagtcccagggaacttatttcctggtcagcatggtattccaaatcctgttcggcttccttgccagcttaattgtcatgtggttcagccgacaacgcgaataccgcgccgacgcgggcgcggcaaaactggtcggcgcgccgaaaatgatttccgccctgcaaaggcttaaaggcaacccggtcgatttgcccgaagaaatgaacgcaatgggcatcgccggagatacgcgcgactccctgctcagcacccacccttcgctggacaaccgaatcgcccgcctcaaatcgctttaa

SEQ ID NO: 40751 - protein, 226 aa, Neisseria meningitidis; identical to SEQ ID NO: 40747

SEQ ID NO: 40752 - DNA, 1380 bp, Neisseria gonorrhoeae
atgctgctcgacctcgaccgcttttccttttccgtcttcctgaaagaaatccgcctgctgaccgcccttgccctgcccatgctgttggcgcaggtcgcgcaggtgggcatcggtttcgtcgataccgtgatggcgggcggtgcgggcaaggaagatttggcggcggtggctttgggcagcagcgcgtttgccacggtttatattacctttatgggcattatggcggcgctgaacccgatgattgcccagctttacggcgcgggtaaaaccggtgaagcaggcgaaacggggcggcaggggatttggttcgggctgattttggggattttcggcatgattttgatgtgggcggcgattacgccgttccgcaactggctgactttgagcgattatgtggaaggcacaatggcgcagtatatgctgttcaccagcttggcgatgccggcggcaatggtacaccgcgcactgcacgcctacgcttccagcctgaaccgcccgcgcctgattatgttggtcagctttgcggcgtttgtgttgaacgtgccgctgaactatattttcgtttacggcaaattcggtatgcccgctttgggtggcgcaggttgcggcgtggcgacaatggcggtgttttggttcagcgcgctggcattgtggatttatatcgccaaggaaaaattcttccgcccgttcggactgacagcgaaattcggcaaaccggattgggcggtgttcaaacagatttggaaaatcggcgcgcccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcagggacggtgcgcatcggcttttcgcttgggcggcgcgaattttcgcgggcgcgttatatttcaggagtgtcgctggtgtcgggctgggtgctcgccgtgattaccgtgctttccttggtattattccgttcgccgctggcaagcatgtacaacgatgatccggcagttttaagcatcgcctccaccgtcctgctgttcgccggcctgttccaaccggcagacttcacccaatgtatcgcgtcctatgccctgcgcggctacaaagtcaccaaggtgccgatgttcatccacgccgccgccttctggggctgcggcctgctgccgggctatctgctcgcctaccgtttcgatatgggcatttacggcttctggacggcattgattgcctcgctcaccatcgcagccgtcgccttggtgtggtgcttggaaaaatacagtatggagttggtcaaatcacacaaggccgtctga

SEQ ID NO: 40753 - protein, 459 aa, Neisseria gonorrhoeae
MLLDLDRFSFSVFLKEIRLLTALALPMLLAQVAQVGIGFVDTVMAGGAGKEDLAAVALGSSAFATVYITFMGIMAALNPMIAQLYGAGKTGEAGETGRQGIWFGLILGIFGMILMWAAITPFRNWLTLSDYVEGTMAQYMLFTSLAMPAAMVHRALHAYASSLNRPRLIMLVSFAAFVLNVPLNYIFVYGKFGMPALGGAGCGVATMAVFWFSALALWIYIAKEKFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWVLAVITVLSLVLFRSPLASMYNDDPAVLSIASTVLLFAGLFQPADFTQCIASYALRGYKVTKVPMFIHAAAFWGCGLLPGYLLAYRFDMGIYGFWTALIASLTIAAVALVWCLEKYSMELVKSHKAV

SEQ ID NO: 40754 - DNA, 1380 bp, Neisseria meningitidis
atgctgctcgacctcaaccgcttttcctttcccgtcttcctgaaagaagtccgcctgctgaccactcttgccctgcccatgctgttggcgcaggtcgcgcaggtgggcatcggttttgtcgatactgtgatggcgggcggtgcgggcaaggaagacttggcggcggtggctttgggcagcagcgcgtttgccacggtttatattacctttatgggcattatggcggcgctgaacccgatgattgcccagctttacggcgcgggtaaaaccgacgaagtgggcgaaacggggcggcaggggatttggttcgggctgtttttgggcgtgttcggcatggtcttgatgtgggcggcgattacgccgttccgcaactggctgaccttgagcgattatgtggaaggcacgatggcgcagtatatgttgttcaccagcttggcgatgccggcggcaatggtacaccgcgcgctgcacgcctacacttccagcctgaaccgcccgcgcctgattatgttggtcagctttgcggcgtttgtgttgaacgtgccgctgaactatattttcgtttacggcaaattcggtatgcccgctttgggcggcgcaggctgcggactggcgacgatggcggtgttttggttcagcgcgctggcattgtggatttatatcgccaaggaaaatttcttccgcccattcggactgacggcgaaattcggcaaaccggattgggcggtgttcaaacagatttggaaaatcggcgcacccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcggggacggtgcgcatcggcttttcgcttgggcggcgcgaattttcgcgggcgcgttatatttcgggcgtgtcactggtgttaggatggatgctcgccgtgattaccgtgctttccttggtattattccgttcgccgctggtaagtatgtacaacaatgatccggcggttttaagcatcgccgccaccgtcttactgttcgccggcttgttccaaccggcagacttcacccaatgtatcgcctcctacgccttgcgcggctacaaagttacaaaggtgccgatgttcatccacgccgccgccttttggggctgcggcctgctgccgggctatctgctcgcctaccgtttcaatatgggcatttacggcttctggacggcattgattgcctcgctcaccatcgccgccatcgccttggtgtggtgcttggaattgtgcagtagggagatggtcagatcgcataaggccgtctga

SEQ ID NO: 40755 - protein, 459 aa, Neisseria meningitidis
MLLDLNRFSFPVFLKEVRLLTTLALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYTSSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVLGWMLAVITVLSLVLFRSPLVSMYNNDPAVLSIAATVLLFAGLFQPADFTQCIASYALRGYKVTKVPMFIHAAAFWGCGLLPGYLLAYRFNMGIYGFWTALIASLTIAAIALVWCLELCSREMVRSHKAV

SEQ ID NO: 40756 - DNA, 1380 bp, Neisseria meningitidis
atgctgctcgacctcaaccgcttttccttttccgtcttcctgaaagaagtccgcctgctgaccgctcttgccctgcccatgctgttggcgcaggtcgcgcaggtgggcatcggttttgtcgataccgtgatggcgggcggtgcgggcaaggaagacttggcggcggtggctttgggcagcagcgcgtttgccacggtttatattacctttatgggcattatggcggcgctgaacccgatgattgcccagctttacggcgcgggtaaaaccgacgaagtgggcgaaacgggacggcaggggatttggttcgggctgtttttgggcgtgttcggcatggtcttgatgtgggcggcgattacgccgttccgcaactggctgaccttgagcgattatgtggaaggcacaatggcgcagtatatgctgttcaccagcttggcgatgccggcggcaatggtacaccgcgcactgcacgcctacgcctccagcctgaaccgcccgcgcctgattatgttggtcagctttgcggcgtttgtgttgaacgtgccgctgaactatattttcgtttacggcaaattcggtatgcccgctttgggcggcgcaggctgcggactggcgacgatggcggtgttttggttcagcgcgctggcattgtggatttatatcgccaaggaaaatttcttccgcccattcggactgacggcgaaattcggcaaaccggattgggcggtgttcaaacagatttggaaaatcggcgcacccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcggggacggtgcgcatcggcttttcgcttgggcggcgcgaattttcgcgggcgcgttatatttcgggcgtgtcactggtgtcaggatggatgctcgccgtgattaccgtgctttccttggtattattccgttcgccgctggtaagtatgtacaacaatgatccggcggttttaagcatcgccgccaccgtcttactgttcgccggcttgttccaaccggcagacttcacccaatgtatcgcctcctacgccttgcgcggctacaaagttacaaaggtgccgatgttcatccacgccgccgccttttggggctgcggtctgctgccgggctacctgctcgcctaccgtttcgatatgggcatttacggcttctggacggcattgattgcctcgctcaccatcgccgccatcgccttggtgtggtgcttggaattgtgcagtagggagatggtcagatcgcataaggctgtctga

SEQ ID NO: 40757 - protein, 459 aa, Neisseria meningitidis
MLLDLNRFSFSVFLKEVRLLTALALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYASSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWMLAVITVLSLVLFRSPLVSMYNNDPAVLSIAATVLLFAGLFQPADFTQCIASYALRGYKVTKVPMFIHAAAFWGCGLLPGYLLAYRFDMGIYGFWTALIASLTIAAIALVWCLELCSREMVRSHKAV

SEQ ID NO: 40758 - DNA, 567 bp, Neisseria gonorrhoeae
atgtccgccctcctccccatcatcaaccgcctgattctgcaaagcccggacagccgctcggaacttacctcctttgcaggcaaaacactgaccctgaacattgccgggctgaaactggcgggacgcatcacagaagacggtttgctctcggcgggaaacggctttgcagacaccgaaattaccttccgcaacagcgcgatacggaaaatcctccaaggcggcgaacccggggctggcgacatcaggctcgaaggcgacctcatcctcggcatcgcggtactgtccctgctcggcagcctgcgttcccgcgcatcggacgaattggcacggattttcggcacgcaggcaggcatcggcagccgtgccaccgacatcggacacggcatcaaacaaatcggcaggaacatcgccgaacaaatcggcggattttcccgcgaacccgagtccgcaaacaccggcaacgaagcccttgccgactgcctcgacgaaataagcagactgcgcgacggcgtggaacgcctcaacgaacgcctcgacaggctcgaacgcgacatttggatagactaa

SEQ ID NO: 40759 - protein, 188 aa, Neisseria gonorrhoeae
MSALLPIINRLILQSPDSRSELTSFAGKTLTLNIAGLKLAGRITEDGLLSAGNGFADTEITFRNSAIRKILQGGEPGAGDIRLEGDLILGIAVLSLLGSLRSRASDELARIFGTQAGIGSRATDIGHGIKQIGRNIAEQIGGFSREPESANTGNEALADCLDEISRLRDGVERLNERLDRLERDIWID

SEQ ID NO: 40760 - DNA, 567 bp, Neisseria meningitidis
atgtccgccctcctccccatcatcaaccgcctgattctgcaaagcccggacagccgctcggaacttgccgcctttgcaggcaaaacactgaccctgaacattgccgggctgaaactggcgggacgcatcacggaagacggtttgctctcggcgggaaacggctttgcagacaccgaaattaccttccgcaacagcgcggtacagaaaatcctccaaggaggcgaacccggggcgggcgacatcgggctcgaaggcgacctcatcctcggcatcgcggtactgtccctgctcggcagcctgcgttcccgcgcatcggacgaattggcacggattttcggcacgcaggcagacatcggcagccgtgccgccgacatcggacacggcatcaaacaaatcggcaggaacatcgccgaacaaatcggcggattttcccgcgaatccgagtccgcaaacatcggcaacgaagcccttgccgactgcctcgacgaaataagcagactgcgcgacggcgtggaacgcctcaacgaacgcctcgaccggctcgaacgcgacatttggatagactaa

SEQ ID NO: 40761 - protein, 188 aa, Neisseria meningitidis
MSALLPIINRLILQSPDSRSELAAFAGKTLTLNIAGLKLAGRITEDGLLSAGNGFADTEITFRNSAVQKILQGGEPGAGDIGLEGDLILGIAVLSLLGSLRSRASDELARIFGTQADIGSRAADIGHGIKQIGRNIAEQIGGFSRESESANIGNEALADCLDEISRLRDGVERLNERLDRLERDIWID

SEQ ID NO: 40762 - DNA, 567 bp, Neisseria meningitidis
atgtccgccctcctccccatcatcaaccgcctgattctgcaaagcccggacagccgctcggaacttgccgccttcgcaggcaaaacactgaccctgaacattgccgggttgaaactggcgggacgcatcacggaagacggtttgctctcggcgggaaacggctttgcagacaccgaaatcaccttccgcaacagcgcggtacagaaaatcctccaaggcggcgaacccggggcgggcgacatcgggctcgaaggcgacctcatcctcggcatcgcggtactgtccctgctcggcagcctgcgttcccgcgcatcggacgaattggcacggattttcggcacgcaggcagacatcggcagccgtgccgccgacatcggacacggcatcaaacaaatcggcaggaacatcgccgaacaaatcggcagattttcccgcgaacccgagtccgcaaacatcggcaacgaagcccttgccgactgcctcgacgaaataagcagactgcgcgacggcgtggaacgcctcaacgaacgcctcgaccggctcgaacgcgacatttggatagactaa

SEQ ID NO: 40763 - protein, 188 aa, Neisseria meningitidis
MSALLPIINRLILQSPDSRSELAAFAGKTLTLNIAGLKLAGRITEDGLLSAGNGFADTEITFRNSAVQKILQGGEPGAGDIGLEGDLILGIAVLSLLGSLRSRASDELARIFGTQADIGSRAADIGHGIKQIGRNIAEQIGRFSREPESANIGNEALADCLDEISRLRDGVERLNERLDRLERDIWID

SEQ ID NO: 40764 - DNA, 396 bp, Neisseria gonorrhoeae
atggttgtggatagactcgaaattctcgctctcgacgacgaaactcttgatgcgtttgtcggcaatcagcgaagtagcgacatcgcgcaccatatcttccacgaatttcgggttttcgtaggccttttcggtaacgtatttttcatcggggcgtttgagcaggccgtagagttggcagctcgcctgcgtttccacataatcgataacttcctcgataccgacttcggcatcggaagtcaggctgacggtaacgtgcgaacgctgattatgcgcgccatattgggaaatttctttggaacacgggcaaagcgaggttacgggaatcatgaccttcatactgtggccgtatgccccgtctttcatttcacccgtgaggctgacatcataatccagtaa

SEQ ID NO: 40765 - protein, 131 aa, Neisseria gonorrhoeae
MVVDRLEILALDDETLDAFVGNQRSSDIAHHIFHEFRVFVGLFGNVFFIGAFEQAVELAARLRFHIIDNFLDTDFGIGSQADGNVRTLIMRAILGNFFGTRAKRGYGNHDLHTVAVCPVFHFTREADIIIQ

SEQ ID NO: 40766 - DNA, 396 bp, Neisseria meningitidis
atggttgtggatagactcgaaattctcgctctcgacgacgaaactcttgatgcgtttgtcggcaatcagcgaagtagcgacatcgcgcaccatatcttccacgaatttcgggttttcgtaggctttttcggtaacgtatttttcatcggggcgtttgagcaggccgtagagttggcagctcgcctgcgcctccacataatcgatgacttcctcgataccgacttcggcatcggcagtcaggctgacggtaacgtgcgaacgctggttgtgcgcgccgtattgggaaatttctttggaacacgggcaaagcgaggttacgggaatcatgaccttcatactgtggccgtatgccccgtctttgatttcgcccgtgagacagacatcataatccagtaa

SEQ ID NO: 40767 - protein, 131 aa, Neisseria meningitidis
MVVDRLEILALDDETLDAFVGNQRSSDIAHHIFHEFRVFVGFFGNVFFIGAFEQAVELAARLRLHIIDDFLDTDFGIGSQADGNVRTLVVRAVLGNFFGTRAKRGYGNHDLHTVAVCPVFDFARETDIIIQ

SEQ ID NO: 40768 - DNA, 396 bp, Neisseria meningitidis
atggttgtggatagactcgaaattctcgctctcgacgacgaaactcttgatgcgtttgtcggcaatcagcgaagtagcgacatcgcgcaccatatcttccacgaatttcgggttttcgtaggctttttcggtaacgtatttttcatcggggcgtttgagcaggccgtagagttggcagctcgcctgcgcctccacataatcgatgacttcctcgataccgacttcggcatcggcagtcaggctgacggtaacgtgcgaacgctggttgtgcgcgccatattgggaaatttctttggaacacgggcaaagcgaggttacgggaatcatgaccttcatactgtggccgtatgcaccgtctttcatttcgcccgtgaggctgacatcataatccagtaa

SEQ ID NO: 40769 - protein, 131 aa, Neisseria meningitidis
MVVDRLEILALDDETLDAFVGNQRSSDIAHHIFHEFRVFVGFFGNVFFIGAFEQAVELAARLRLHIIDDFLDTDFGIGSQADGNVRTLVVRAILGNFFGTRAKRGYGNHDLHTVAVCTVFHFAREADIIIQ

SEQ ID NO: 40770 - DNA, 1017 bp, Neisseria gonorrhoeae
atgattggagggcttatgcaatttccttaccgcaatgttccggcttcgcgtatgcgccgtatgcgcagggatgatttttcacgccgcctgatgcgcgagcatatgctgaccgccgatgatttgatttatccggtgttcgtattggagggggcggcgcgcgaggaggatgtgccttctatgccgggcgtgaagcgtcagagtttggacaggctgctgtttacggcggaagaggcggtgaagctcggtattccgatgttggcactctttcccgtggttacggcaaacaaaaccgggcgtgcgcaggaggcgtacaatcccgaaggactcgtgccgtcaactgtccgagccttgcgcgagaggtttcccgaactggggattatgacggatgtcgcgctcgatccttatacggtgcacggtcaggacggactgacggacgaaaacggttacgtgatgaatgatgaaaccgtagaagtcttggtgaaacaggctttatgtcatgcagaggcgggcacgcaggtcgttgctccttccgatatgatggacgggcgtatcggcgccatccgcgaggctttggaggatgccggacatatccatacgcggattatggcatattccgccaaatatgcttctgcattctacggccctttccgtgatgcggtaggcagttcgggcaatttgggaaaggcagataaaaagacctatcagatggatcctgcaaataccgatgaggcgctgcatgaagtggcgctcgatattcaggaaggtgcggatatggtgatggtgaagcccggtttgccgtatttggacgttgtccgccgcgtgaaggacgagttcggcgtaccgacttatgcctatcaggtttcgggcgaatatgcgatgttgcaggcggcggttgccaacggctggctggacggcggcaaagtggttttggaaagcctgctggcattcaaacgtgcgggtgcggacgggattttgacctattacgccattgaggcggcaaagatgctgaagcgttga

SEQ ID NO: 40771 - protein, 338 aa, Neisseria gonorrhoeae
MIGGLMQFPYRNVPASRMRRMRRDDFSRRLMREHMLTADDLIYPVFVLEGAAREEDVPSMPGVKRQSLDRLLFTAEEAVKLGIPMLALFPVVTANKTGRAQEAYNPEGLVPSTVRALRERFPELGIMTDVALDPYTVHGQDGLTDENGYVMNDETVEVLVKQALCHAEAGTQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAVANGWLDGGKVVLESLLAFKRAGADGILTYYAIEAAKMLKR

SEQ ID NO: 40772 - DNA, 1017 bp, Neisseria meningitidis
atgattggagggcttatgcagtttccttaccgcaatgttccggcttcgcgtatgcgccgtatgcgcagggacgatttttcacgccgcctgatgcgcgaacacacgctgaccgccgatgatttgatttatccggtgttcgtattggaggggtcggcgcgcgaggaggatgtgccttctatgccgggtgtgaagcgtcaaagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatgacggatgtcgcgctcgatccttatacggttcacggtcaggacgggctgacggacgaaaacggttatgtgatgaacgatgaaaccgtagaggttttggtcaagcaggctttgtgccacgctgaagcgggcgcgcaggtggttgccccttccgatatgatggacgggcgtatcggtgcgattcgcgaggcgttggaggatgccgggcatatccatacgcggattatggcgtattccgccaaatatgcttctgcattttacggccctttccgtgatgcggtaggcagttcgggcaatttgggcaaggcagataaaaagacctaccagatggatccggcaaataccgatgaggcgttgcacgaagtggcgttggacattcaggaaggtgcggatatggtaatggtcaagcccggtttgccgtatttggacgttgtccgccgcgtaaaggacgagttcggtgtgccgacttatgcctatcaggtttcgggagaatacgcgatgttgcaggcagcgattgccaacggctggctggacggcggcaaagtggttttggaaagcctgctggcattcaaacgtgcgggtgcggacgggattttgacctattacgctattgaggcggcaaagatgttgaagcgttga

SEQ ID NO: 40773 - protein, 338 aa, Neisseria meningitidis
MIGGLMQFPYRNVPASRMRRMRRDDFSRRLMREHTLTADDLIYPVFVLEGSAREEDVPSMPGVKRQSLDRLLFTAEEAVKLGIPMLALFPVVTANKTERAQEAYNPEGLVPSTVRALRERFPELGIMTDVALDPYTVHGQDGLTDENGYVMNDETVEVLVKQALCHAEAGAQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAIANGWLDGGKVVLESLLAFKRAGADGILTYYAIEAAKMLKR

SEQ ID NO: 40774 - DNA, 1017 bp, Neisseria meningitidis
atgattggagggcttatgcagtttccttaccgcaatgtttcggcttcgcgtatgcgccgtatgcgcagggacgatttttcacgccgcctgatgcgcgagcatacgctgactgccgatgatttgatttatccggtgttcgtattggaggggtcggcgcgcgaggaggatgtgccttctatgccgggcgtgaagcgtcagagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatgacggatgtcgcgctcgatccttatacggtgcacggtcaggacgggctgacggacgaaaacggttatgtgatgaacgatgaaaccgtagaggttttggtcaagcaggctttgtgtcatgcagaggcaggcgcacaggtcgttgctccttccgatatgatggatgggcgtatcggtgcgattcgcgaggcgttggaggatgccgggcatatccatacgcggattatggcgtattccgccaaatatgcttctgcattttacggccctttccgtgatgcggtaggcagttcgggcaatttgggcaaggcagataaaaagacctaccagatggatccggcaaataccgatgaggcgttgcacgaagtggcgttggacattcaggaaggtgcggatatggtgatggtcaagcccggtttgccgtatttggacgttgtccgccgcgtgaaggacgagttcggcgtgccgacttatgcctatcaggtttcgggagaatacgcgatgctgcaggcggcggttgccaacggctggctggacggcggcaaagtggttttggaaagcctgctggcattcaaacgtgcgggtgcggatgggattttgacctattacgccattgaggcggcaaagatgctgaagcgttga

SEQ ID NO: 40775 - protein, 338 aa, Neisseria meningitidis
MIGGLMQFPYRNVSASRMRRMRRDDFSRRLMREHTLTADDLIYPVFVLEGSAREEDVPSMPGVKRQSLDRLLFTAEEAVKLGIPMLALFPVVTANKTERAQEAYNPEGLVPSTVRALRERFPELGIMTDVALDPYTVHGQDGLTDENGYVMNDETVEVLVKQALCHAEAGAQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAVANGWLDGGKVVLESLLAFKRAGADGILTYYAIEAAKMLKR

SEQ ID NO: 40776 - DNA, 543 bp, Neisseria gonorrhoeae
atgccgtctgaaaacgggatgggaaaacggcagcttgcgggctgccgtttgttcgggaagttaagccttgttttcaggctgctgcccggactctgtcgaggcggtgtctgccggggcaggtgcttcggttttttcccgagtcggagcgtgcggcgcgttatcttccgccgcgtccgcattctcgcgcaggttgtggctgttatccttgggcgggctgggttgtttgcccgccataatttccagtacctgatcgcggtctatggtttcccattccatcagggctttgcacatcgtttccatcttgtcgcggttttcatcgaggattttgtaggcaacctgatactgctcgtccaaaatccggcggatttccgcgtcgatgtcctgctgggttttctcggaaatgttttgcgaacgggttacgctgcgccccaagaagacttcgccttcgttttccgcataaaccatcacgcccattttgtcgctcatgccgtagcgcgttaccatttcgcgtgccatttgggttgcgcgttcaaagtcgtttga

SEQ ID NO: 40777 - protein, 180 aa, Neisseria gonorrhoeae
MPSENGMGKRQLAGCRLFGKLSLVFRLLPGLCRGGVCRGRCFGFFPSRSVRRVIFRRVRILAQVVAVILGRAGLFARHNFQYLIAVYGFPFHQGFAHRFHLVAVFIEDFVGNLILLVQNPADFRVDVLLGFLGNVLRTGYAAPQEDFAFVFRINHHAHFVAHAVARYHFACHLGCAFKVV

SEQ ID NO: 40778 - DNA, 543 bp, Neisseria meningitidis
atgccgtctgaaaacgggatgggaaaacggcagcttgcgggctgccgtttgttcgggaagttaagccttgttttcaggctgctgctcggactctgtcgaagcggtgtctgccggggcaggtgcttcggtttcttcccgagtcggagcgtgcggcgcgttatcttccgccgcgtccgcattctcgcgcaggttgtggctgtaatctttgggcgggctgggttgtttgcccgccatgatttccagtacctgatcgcggtcgatggtttcccattccatcagggctttgcacatcgtttccatcttgtcgcggttttcatcgaggattttgtaggcaacctgatattgctcgtccaaaatccggcggatttccgcgtcgatgtcctgctgggttttctcggaaatgttttgcgaacgggttacgctgcgtcccaagaagacttcgccttcgttttccgcataaaccatcacgcccattttgtcgctcatgccgtagcgcgttaccatttcgcgcgccatttgggttgcgcgttcaaagtcgtttga

SEQ ID NO: 40779 - protein, 180 aa, Neisseria meningitidis
MPSENGMGKRQLAGCRLFGKLSLVFRLLLGLCRSGVCRGRCFGFFPSRSVRRVIFRRVRILAQVVAVIFGRAGLFARHDFQYLIAVDGFPFHQGFAHRFHLVAVFIEDFVGNLILLVQNPADFRVDVLLGFLGNVLRTGYAASQEDFAFVFRINHHAHFVAHAVARYHFARHLGCAFKVV

SEQ ID NO: 40780 - DNA, 543 bp, Neisseria meningitidis
atgccgtctgaaaacaggatgggaaaacggcagcttgcgggctgccgtttgttcgggaagttaagccttgttttcaggctgctgctcggactctgtcgaagcggtgtctgccggggcaggtgcttcggtttcttcccgagtcggagcgtgcggcgcgttatcttccgccgcgtccgcattctcgcgcaggttgtggctgtaatctttgggcgggctgggttgtttgcccgccatgatttccagtacctgatcgcggtcgatggtttcccattccatcagggctttgcacatcgtttccatcttgtcgcggttttcatcgaggattttgtaggcaacctgatactgctcgtccaaaatccggcggatttccgcatcgatgtcctgctgggttttctcggaaatgttttgcgaacgggttacgctgcgtcccaagaagacttcgccttcgttttccgcataaaccatcacgcccattttgtcgctcatgccgtagcgcgttaccatttcgcgcgccatttgggttgcgcgttcaaagtcgtttga

SEQ ID NO: 40781 - protein, 180 aa, Neisseria meningitidis
MPSENRMGKRQLAGCRLFGKLSLVFRLLLGLCRSGVCRGRCFGFFPSRSVRRVIFRRVRILAQVVAVIFGRAGLFARHDFQYLIAVDGFPFHQGFAHRFHLVAVFIEDFVGNLILLVQNPADFRIDVLLGFLGNVLRTGYAASQEDFAFVFRINHHAHFVAHAVARYHFARHLGCAFKVV

SEQ ID NO: 40782 - DNA, 375 bp, Neisseria gonorrhoeae
atgggcttcggcggcaatattgcaaaaaagctggccggggtagatgaaatagcctttgactttgacggcatcgtctttgatttcgggcgtgatgatgctgtccggcatagcggcgtaatcaatgctgctgtcgccggcctgcatatagtcggtgaagttttcgctgataaagcggtagaaaagtgtgccgagaacgtattgtttaaagtcccagccatccaccgcgccgcgtacttcgtcggcgattttccaaatttggcggtgcagttgggcgcgttgttgcatttcggtcatcatcgaaatccatatataaagttaaacaaatcaaaatcgcctgatattttcagacgatttttttacgggcattcaaattaa

SEQ ID NO: 40783 - protein, 124 aa, Neisseria gonorrhoeae
MGFGGNIAKKLAGVDEIAFDFDGIVFDFGRDDAVRHSGVINAAVAGLHIVGEVFADKAVEKCAENVLFKVPAIHRAAYFVGDFPNLAVQLGALLHFGHHRNPYIKLNKSKSPDIFRRFFYGHSN

SEQ ID NO: 40784 - DNA, 374 bp, Neisseria meningitidis
atgggcttcggcggcaatattgcaaaaaagctggccggggtagatgaaatagcctttaactttgacggcatcgtctttgatttcgggcgtgatgatgctgtccggcatagcggcgtaatcaatactgctgtcgcctgcctgcatatagtcggtgaagttttcgctgataaagcggtagaaaagtgtgccgagaacgtattgtttaaagtcccagccatccaccgcgccgcgtacttcgtcggcaattttccaaatttggcggtgcagttgggcgcgttgttgcatttcggtcatcatcgaaatccatataaaagttaaacaaatcaaaatcgcctgatattttcagacgatttttttacgggcattcaaattaa

SEQ ID NO: 40785 - protein, 124 aa, Neisseria meningitidis
  misc_feature (104)..(104): Xaa can be any naturally occurring amino acid
MGFGGNIAKKLAGVDEIAFNFDGIVFDFGRDDAVRHSGVINTAVACLHIVGEVFADKAVEKCAENVLFKVPAIHRAAYFVGNFPNLAVQLGALLHFGHHRNPYXKLNKSKSPDIFRRFFYGHSN

SEQ ID NO: 40786 - DNA, 373 bp, Neisseria meningitidis
atgggcttcggcggcaatattgcaaaaaagctggccggggtagatgaaatagcctttgactttgacggcatcgtctttgatttcgggcgtgatgatgctgtccggcatagcggcgtaatcaatactgctgtcgcctgcctgcatatagtcggtaaagttttcgctgataaagcggtagaaaagtgtgccgagaacgtattgtttgaagtcccagccatccaccgcgccgcgtacttcgtcggcaattttccaaatttggcggtgcagttgggcgcgttgttgtatttcggtcatcatcgaaatccatataaaagttaaacaaatcaaaatcgcctgatattttcagacgattttttacgggcattcaaattaa

SEQ ID NO: 40787 - protein, 124 aa, Neisseria meningitidis
  misc_feature (104)..(104): Xaa can be any naturally occurring amino acid
  misc_feature (120)..(120): Xaa can be any naturally occurring amino acid
MGFGGNIAKKLAGVDEIAFDFDGIVFDFGRDDAVRHSGVINTAVACLHIVGKVFADKAVEKCAENVLFEVPAIHRAAYFVGNFPNLAVQLGALLYFGHHRNPYXKLNKSKSPDIFRRFFXGHSN

SEQ ID NO: 40788 - DNA, 615 bp, Neisseria gonorrhoeae
atgtcgcgttcgagcctgtcgaggcgttcgttgaggcgttccacgccgtcgcgcagtctgcttatttcgtcgaggcagtcggcaagggcttcgttgccggtgtttgcggactcgggttcgcgggaaaatccgccgatttgttcggcgatgttcctgccgatttgtttgatgccgtgtccgatgtcggtggcacggctgccgatgcctgcctgcgtgccgaaaatccgtgccaattcgtccgatgcgcgggaacgcaggctgccgagcagggacagtaccgcgatgccgaggatgaggtcgccttcgagcctgatgtcgccagccccgggttcgccgccttggaggattttccgtatcgcgctgttgcggaaggtaatttcggtgtctgcaaagccgtttcccgccgagagcaaaccgtcttctgtgatgcgtcccgccagtttcagcccggcaatgttcagggtcagtgttttgcctgcaaaggaggtaagttccgagcggctgtccgggctttgcagaatcaggcggttgatgatggggaggagggcggacatattttctgattggggcggagaatgcctgttgttgctgttgccgcttattttacaggcttaa

SEQ ID NO: 40789 - protein, 204 aa, Neisseria gonorrhoeae
MSRSSLSRRSLRRSTPSRSLLISSRQSARASLPVFADSGSRENPPICSAMFLPICLMPCPMSVARLPMPACVPKIRANSSDARERRLPSRDSTAMPRMRSPSSLMSPAPGSPPWRIFRIALLRKVISVSAKPFPAESKPSSVMRPASFSPAMFRVSVLPAKEVSSERLSGLCRIRRLMMGRRADIFSDWGGECLLLLLPLILQA

SEQ ID NO: 40790 - DNA, 615 bp, Neisseria meningitidis
atgtcgcgttcgagccggtcgaggcgttcgttgaggcgttccacgccgtcgcgcagtctgcttatttcgtcgaggcagtcggcaagggcttcgttgccgatgtttgcggactcggattcgcgggaaaatccgccgatttgttcggcgatgttcctgccgatttgtttgatgccgtgtccgatgtcggcggcacggctgccgatgtctgcctgcgtgccgaaaatccgtgccaattcgtccgatgcgcgggaacgcaggctgccgagcagggacagtaccgcgatgccgaggatgaggtcgccttcgagcccgatgtcgcccgccccgggttcgcctccttggaggattttctgtaccgcgctgttgcggaaggtaatttcggtgtctgcaaagccgtttcccgccgagagcaaaccgtcttccgtgatgcgtcccgccagtttcagcccggcaatgttcagggtcagtgttttgcctgcaaaggcggcaagttccgagcggctgtccgggctttgcagaatcaggcggttgatgatggggaggagggcggacatattttctgatcggggcggagaatgcctgttgttgctgttgccgcttattttacaggcttaa

SEQ ID NO: 40791 - protein, 204 aa, Neisseria meningitidis
MSRSSRSRRSLRRSTPSRSLLISSRQSARASLPMFADSDSRENPPICSAMFLPICLMPCPMSAARLPMSACVPKIRANSSDARERRLPSRDSTAMPRMRSPSSPMSPAPGSPPWRIFCTALLRKVISVSAKPFPAESKPSSVMRPASFSPAMFRVSVLPAKAASSERLSGLCRIRRLMMGRRADIFSDRGGECLLLLLPLILQA

SEQ ID NO: 40792 - DNA, 615 bp, Neisseria meningitidis
atgtcgcgttcgagccggtcgaggcgttcgttgaggcgttccacgccgtcgcgcagtctgcttatttcgtcgaggcagtcggcaagggcttcgttgccgatgtttgcggactcgggttcgcgggaaaatctgccgatttgttcggcgatgttcctgccgatttgtttgatgccgtgtccgatgtcggcggcacggctgccgatgtctgcctgcgtgccgaaaatccgtgccaattcgtccgatgcgcgggaacgcaggctgccgagcagggacagtaccgcgatgccgaggatgaggtcgccttcgagcccgatgtcgcccgccccgggttcgccgccttggaggattttctgtaccgcgctgttgcggaaggtgatttcggtgtctgcaaagccgtttcccgccgagagcaaaccgtcttccgtgatgcgtcccgccagtttcaacccggcaatgttcagggtcagtgttttgcctgcgaaggcggcaagttccgagcggctgtccgggctttgcagaatcaggcggttgatgatggggaggagggcggacatattttctgatcggggcggagaatgcctgttgttgctgttgacgcttattttacaggcttaa

SEQ ID NO: 40793 - protein, 204 aa, Neisseria meningitidis
MSRSSRSRRSLRRSTPSRSLLISSRQSARASLPMFADSGSRENLPICSAMFLPICLMPCPMSAARLPMSACVPKIRANSSDARERRLPSRDSTAMPRMRSPSSPMSPAPGSPPWRIFCTALLRKVISVSAKPFPAESKPSSVMRPASFNPAMFRVSVLPAKAASSERLSGLCRIRRLMMGRRADIFSDRGGECLLLLLTLILQA

SEQ ID NO: 40794 - DNA, 1176 bp, Neisseria gonorrhoeae
  misc_feature (960)..(960): n is a, c, g, or t
atggctgcgttcaacgctttggacggcaaaaaagaagacaacgggcaaatcgaatattctcagttcatccgacaggtcaacaacggcgaagtatccggcgtcaacatcgaaggatccgtcgtcagcggttacctgattaaaggcgagcgcaccgacaaaagcaccttcttcaccaacgcgcccttggatgacaacctgattcaaacccttttgaacaaaaacgtccgcgtaaaagtaacgccggaagaaaaaccgagcgcgctgactgccctgttttacagcctgctgcccgtcctgctgctgattggcgcatggttctactttatgcgtatgcaggcgggcggcggcggaaaaggcggcgcattctccttcggcaaaagccgcgcccgcctgctggacaaagatgccaacaaagttacctttgccgatgtcgccggctgcgacgaagccaaagaagaagtgcaggaaatcgtcgattacctcaaagcaccgaaccgctatcaaagcctcggcggccgtgttccgcgcggcatcctgctggcgggcagcccgggaaccggtaaaacactcttggcgaaagccattgcaggcgaggccggcgtgccgttcttcagcatttccggttccgattttgtcgaaatgttcgtcggtgtcggtgcaagccgcgtccgcgatatgttcgagcaggcaaagaaaaacgccccatgcattatctttatcgacgagattgacgcggtaggccgccaacgcggcgcaggtttgggcggcggcaatgatgagcgcgagcaaacattaaaccaattattggttgaaatggacggttttgagagcaatcagactgtaattgtgattgcggcaaccaaccgccccgacgtactcgatcctgcgctgcaacgccccggccgcttcgaccgccaagtcgtcgtccccctgccggacatccgggggcgcgaacagatnttgaacgtccattctaaaaaagtgcctttggacgaatctgtggatttattgtccctcgcgcgcggcacgcccggtttttccggcgcggatttggcgaaactggtcaacgaagcccccctgtttgccggccgccgcaacaaagtgaaagtcgatcaaagcgatttgaagacgccaaagacaaaatctatatgggtccggaacgccgcagtatggtga

SEQ ID NO: 40795 - protein, 391 aa, Neisseria gonorrhoeae
  misc_feature (320)..(320): Xaa can be any naturally occurring amino acid
MAAFNALDGKKEDNGQIEYSQFIRQVNNGEVSGVNIEGSVVSGYLIKGERTDKSTFFTNAPLDDNLIQTLLNKNVRVKVTPEEKPSALTALFYSLLPVLLLIGAWFYFMRMQAGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQXLNVHSKKVPLDESVDLLSLARGTPGFSGADLAKLVNEAPLFAGRRNKVKVDQSDLKTPKTKSIWVRNAAVW

SEQ ID NO: 40796 - DNA, 1176 bp, Neisseria meningitidis
atggctgcgttcaacgctttagacggtaaaaaagaagacaacgggcaaatcgaatactctcagttcatccaacaggtcaacaacggcgaagtatccggcgtcaacatcgaaggatccgtcgtcagcggctacctgattaagggcgagcgcaccgacaaaagcactttcttcaccaacgcgcctttggacgacaacctaattaaaacactgctcgacaaaaacgtccgcgtaaaagtaacgccggaagaaaaaccgagcgcgctggctgccctgttttacagcctgctgcccgtcctgctgctgattggcgcatggttctacttcatgcgtatgcagacgggcggcggcggaaaaggcggcgcattctcattcggtaaaagccgcgcccgcctgctggacaaagatgccaacaaagtgacctttgccgatgtcgccggctgcgacgaagccaaagaagaagtacaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcgagccgcgtccgcgatatgttcgagcaggcgaagaaaaacgccccctgcatcatctttatcgacgagattgacgcagtcggccgccaacgcggcgcaggtttgggcggcggcaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgagggcgcgaacagattttgaacgtccattctaaaaaagtgcctttggacgaatctgtggatttattgtccctcgcgcgcggcacgccgggtttttccggcgcggatttggcgaacttggtcaacgaagccgccctgtttgccggccgccgcaataaagtcaaagtcgatcagagcgatttgaagacgccaaagacaaaatctatatgggtccggaacgccgcagtatggtga

SEQ ID NO: 40797 - protein, 391 aa, Neisseria meningitidis
MAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDESVDLLSLARGTPGFSGADLANLVNEAALFAGRRNKVKVDQSDLKTPKTKSIWVRNAAVW

SEQ ID NO: 40798 - DNA, 1176 bp, Neisseria meningitidis
atggctgcgttcaacgctttagacggtaaaaaagaagacaacgggcaaatcgaatattctcagttcatccaacaggtcaacaacggcgaagtatccggcgtcaacatcgaaggatccgtcgtcagcggctacctgattaagggcgagcgcaccgacaaaagcaccttcttcaccaacgcgcctttggacgacaacctgattaaaacactgctcgacaaaaacgtccgtgtaaaagtaacgccggaagaaaaaccgagcgcgctggctgccctgttttacagcctgctgcccgtcctgctgctgattggcgcgtggttctactttatgcgtatgcagacgggcggcggcggaaaaggcggcgcattctcattcggcaaaagccgcgcccgcctactggacaaagatgccaacaaagttacctttgccgatgtcgccggctgcgacgaagccaaagaagaagtgcaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcaagccgcgtccgcgatatgttcgagcaggcgaagaaaaacgccccctgcatcatctttatcgacgagattgacgcagtcggccgccaacgcggcgcaggtttgggcggcggtaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgggggcgcgaacagattttgaacgtccactctaaaaaagtgcctttggacaaatctgtggatttattgtccctcgcgcgcggcacgccgggtttttccggcgcggatttggcgaacttggtcaacgaagccgccctgtttgccggccgccgcaataaagtcaaagtcgatcagagcgatttgaagacgccaaagacaaaatctatatgggtccggaacgccgcagtatggtga

SEQ ID NO: 40799 - protein, 391 aa, Neisseria meningitidis
MAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDKSVDLLSLARGTPGFSGADLANLVNEAALFAGRRNKVKVDQSDLKTPKTKSIWVRNAAVW

SEQ ID NO: 40800 - DNA, 1116 bp, Neisseria gonorrhoeae
atgtggaaacggcggcggcgcggtgtcggcagctttgaagagcagcgaatagatgccgccggcaaaccacaatgcggaaagcaggctgaagcggttgcgcggcagcttcatgccgcctcctcgtccagccacgtttggcagattttggacaggcgcaggaatttgccgccgcgtgcggcaagtatgtcgcgccattgtgccacttcttcggcggacggtgcttcgtcgatgctgcattcgtacagcaggaaatcgagggtttcttcgatgacggggatggattccgtttggataagctgcttgagttcgttcatgactgttcggatacggaaatcgggaaaatgccgtctgaaagggcttcagacggcattggattatttgctgtgcaggaagcgcgttgcctcttcccatttgccggaaatgatgtcgggtacggcctgcagggatttggcgacggcatcgtcgatttgccggcggtgcttccgcgctcggtttgttcaagacgtagccgacgacgaggttgcggtcgccggggtggccgatgccgaggcgcaggcggtaatagtctgccgtgccgagttttgcctgaatgtctttcaagccgttgtgtccgccgttgccgccgccgagtttgaatttgatccgtccgcaagggatgtcgagttcgtcgtggacgacgaggatttcttcgggtttgattttgtagaactgtgcaagcgcggcaaccgcctgtccggaacggttcatgaacgtggccggtttgagcagccaaacatcgccgtcgggcagggcggcgcgggcaacttcgccgaagaattttttttcttctttaaacgaagccttccatttccacgccagttcgtcgaggaaccaaaagcccgcattgtggcgggtctgttcgtattctttgcccgggttgcccaagccgacaaccattttgattgtgttcgacatgatattttccgtgtttctgtcgaatgcggtctgaaggcttcagacggcatggttattcttcttgattttgaacgcgtgtgcggcgcgcttctttggggtcgatcaacagcgggcggtacacttcgatgcggtcgccgtcgcgcagcggcgtgtcgtctttga

SEQ ID NO: 40801 - protein, 371 aa, Neisseria gonorrhoeae
MWKRRRRGVGSFEEQRIDAAGKPQCGKQAEAVARQLHAASSSSHVWQILDRRRNLPPRAASMSRHCATSSADGASSMLHSYSRKSRVSSMTGMDSVWISCLSSFMTVRIRKSGKCRLKGLQTALDYLLCRKRVASSHLPEMMSGTACRDLATASSICRRCFRARFVQDVADDEVAVAGVADAEAQAVIVCRAEFCLNVFQAVVSAVAAAEFEFDPSARDVEFVVDDEDFFGFDFVELCKRGNRLSGTVHERGRFEQPNIAVGQGGAGNFAEEFFFFFKRSLPFPRQFVEEPKARIVAGLFVFFARVAQADNHFDCVRHDIFRVSVECGLKASDGMVILLDFERVCGALLWGRSTAGGTLRCGRRRAAACRL

SEQ ID NO: 40802 - DNA, 1115 bp, Neisseria meningitidis
atgcggaaaaggcggtggcgcggtttcggcagctttgaaaagcagtgagtaaatgctgcctgcaaaccacaatgccgagagcaggataaagcggttgcgtggcagattcatgcttgttcctcttcaagccatgtctggcatagtttggataggcgcaggaattttccgccgcgtgcggccagcatatcgcgccaaacggcaatttcttcggcggagggggcatcgtctatgctgcattcgtagagcaggaaatcgagggtttcttcgatgacggggatggattcggtttggataagctgcttgagttcggtcatgactgttcggatatggaaatcgggaacatgccgtctgaaagggcttcagacggcatcgggtcatttgctgtgcaggaagcgggttgcttcttcccatttgccggcaaggatgtcgggtatggcttgcagggatttggcgacggcatcgtcaatctgtcggcggtgttccgtactgggtttgttcaggacatagccgacgacgaggttgcggtcgcccgggtggccgatgccgaggcgcaggcggtaatagtctgccgtgccgagttttgcctgaatgtctttcaagccgttgtgtccgccgttgccgccgccgagtttgaatttgatccgtccgcagggaatgtcgagttcgtcgtggacgacgaggatttcttcgggtttgattttgtagaactgtgcaagcgcggcaactgcctgtccggaacggttcatgaacgtggcaggtttgagcagccaaacgtcgccgtcgggcagggcggcacgggcgacttcgccgaagaattttttttcttctttaaatgaagccttccatttccacgccagttcgtcgaggaaccaaaaacccgcattgtggcgtgtctgttcgtattctttgcccgggttgcccaagccgacaaccattttgattgtgtttgacatgatattttccgtgtttctgtcgaatgctgtctgaaggcttcagacggcatggttattcttcttgattttgaacgcgtttgcggcgcgcttctttggggtcgatcaacagcgggcggtacacttcgatgcggtcgccgtcgcgcagcggcgtgtcgtctttga

SEQ ID NO: 40803 - protein, 371 aa, Neisseria meningitidis
  misc_feature (16)..(16): Xaa can be any naturally occurring amino acid
  misc_feature (81)..(81): Xaa can be any naturally occurring amino acid
  misc_feature (161)..(161): Xaa can be any naturally occurring amino acid
  misc_feature (279)..(279): Xaa can be any naturally occurring amino acid
  misc_feature (317)..(317): Xaa can be any naturally occurring amino acid
MRKRRWRGFGSFEKQXVNAACKPQCREQDKAVAWQIHACSSSSHVWHSLDRRRNFPPRAASISRQTAISSAEGASSMLHSXSRKSRVSSMTGMDSVWISCLSSVMTVRIWKSGTCRLKGLQTASGHLLCRKRVASSHLPARMSGMACRDLATASSICRRCXRTGFVQDIADDEVAVARVADAEAQAVIVCRAEFCLNVFQAVVSAVAAAEFEFDPSAGNVEFVVDDEDFFGFDFVELCKRGNCLSGTVHERGRFEQPNVAVGQGGTGDFAEEFFFFFKXSLPFPRQFVEEPKTRIVACLFVFFARVAQADNHFDCVXHDIFRVSVECCLKASDGMVILLDFERVCGALLWGRSTAGGTLRCGRRRAAACRL

SEQ ID NO: 40804 - DNA, 1115 bp, Neisseria meningitidis
atgcggaaacggcggcggcgcggtgtcggcagctttgaagagcagcgaatagatgccgccggcaaaccacaatgcggaaagcaggctgaagcggttgcgcggcagcttcatgccgcctcctcgtccagccacgtttggcagattttggacaggcgcaggaatttgccgccgcgtgcggcaagtatgtcgcgccattgtgccacttcttcggcggatggtgcgtcgtcgatgctgcattcgtacagcaggaaatcgagggtttcttcgatgacggggatggattcggtttggataagctgcttgagttcggtcatgactgttcggatatggaaatcgggaacatgccgtctgaaagggcttcagacggcatcgggtcatttgctgtgcaggaagcgggttgcctcttcacatttgccggcaaggatgtcgggtatggcttgcagggatttggcgacggcatcgtcaatctgtcggcggtgttccgtactgggtttgttcaggacatagccgacgacgaggttgcggtcgcccgggtggccgatgccgaggcgcaggcggtaatagtctgccgtgccgagttttgcctgaatgtctttcaagccgttgtgtccaccgttgccgccgccgagtttgaatttgatccgtccgcagggaatgtcgagttcgtcgtggacgacgaggatttcttcgggtttgattttataaaactgcgcaagggcggcaactgcctgtccggaacggttcatgaacgtggtcggcttgagcagccagacatcgccgtcgggcagggtagcacgggcgacttcgccgaagaattttttttcttctttaaatgaagccttccatttccacgccagttcgtcgaggaaccaaaaacccgcattgtggcgtgtctgttcgtattctttgcccgggttgcccaagccgacaaccattttgattgtgtttgacatgatattttccgtgtttctgccgaatgccgtctgaaggcttcagacggcatggttattcttcttgattttgaacgcgtttgcggcgcgcttctttggggtcgatcaacagcgggcggtacacttcgatgcggtcgccgtcgcgcagcggcgtgtcgtctttga

SEQ ID NO: 40805 - protein, 369 aa, Neisseria meningitidis
  misc_feature (160)..(160): Xaa can be any naturally occurring amino acid
MRKRRRRGVGSFEEQRIDAAGKPQCGKQAEAVARQLHAASSSSHVWQILDRRRNLPPRAASMSRHCATSSADGASSMLHSYSRKSRVSSMTGMDSVWISCLSSVMTVRIWKSGTCRLKGLQTASGHLLCRKRVASSHLPARMSGMACRDLATASSICRRXFRTGFVQDIADDEVAVARVADAEAQAVIVCRAEFCLNVFQAVVSTVAAAEFEFDPSAGNVEFVVDDEDFFGFDFIKLRKGGNCLSGTVHERGRLEQPDIAVGQGSTGDFAEEFFFFFKSLPFPRQFVEEPKTRIVACLFVFFARVAQADNHFDCVHDIFRVSAECRLKASDGMVILLDFERVCGALLWGRSTAGGTLRCGRRRAAACRL

SEQ ID NO: 40806 - DNA, 1206 bp, Neisseria gonorrhoeae
atgtcgaacacaatcaaaatggttgtcggcttgggcaacccgggcaaagaatacgaacagacccgccacaatgcgggcttttggttcctcgacgaactggcgtggaaatggaaggcttcgtttaaagaagaaaaaaaattcttcggcgaagttgcccgcgccgccctgcccgacggcgatgtttggctgctcaaaccggccacgttcatgaaccgttccggacaggcggttgccgcgcttgcacagttctacaaaatcaaacccgaagaaatcctcgtcgtccacgacgaactcgacatcccttgcggacggatcaaattcaaactcggcggcggcaacggcggacacaacggcttgaaagacattcaggcaaaactcggcacggcagactattaccgcctgcgcctcggcatcggccaccccggcgaccgcaacctcgtcgtcggctacgtcttgaacaaaccgagcgcggaagcaccgccggcaaatcgacgatgccgtcgccaaatccctgcaggccgtacccgacatcatttccggcaaatgggaagaggcaacgcgcttcctgcacagcaaataatccaatgccgtctgaagccctttcagacggcattttcccgatttccgtatccgaacagtcatgaacgaactcaagcagcttatccaaacggaatccatccccgtcatcgaagaaaccctcgatttcctgctgtacgaatgcagcatcgacgaagcaccgtccgccgaagaagtggcacaatggcgcgacatacttgccgcacgcggcggcaaattcctgcgcctgtccaaaatctgccaaacgtggctggacgaggaggcggcatgaagctgccgcgcaaccgcttcagcctgctttccgcattgtggtttgccggcggcatctattcgctgctcttcaaagctgccgacaccgcgccgccgccgtttccacatttcgacaaagcagcacaccttgccctgtttttcgcacaaatcttgtttctggccaaagcattcaaaaccggaaaacttcccatcccctaccgcagcctgattgcgttcgccttctgttttgccgtcggcagcgaatgcgcgcaggcatggtttaccgcaacgcgaaccggcagtttgggcgatgtccttgccgacctgacgggcgcagcccttgccctctttgccgcgcgttctgcctgccgcccggactaa

SEQ ID NO: 40807 - protein, 401 aa, Neisseria gonorrhoeae
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSAEAPPANRRCRRQIPAGRTRHHFRQMGRGNALPAQQIIQCRLKPFQTAFSRFPYPNSHERTQAAYPNGIHPRHRRNPRFPAVRMQHRRSTVRRRSGTMARHTCRTRRQIPAPVQNLPNVAGRGGGMKLPRNRFSLLSALWFAGGIYSLLFKAADTAPPPFPHFDKAAHLALFFAQILFLAKAFKTGKLPIPYRSLIAFAFCFAVGSECAQAWFTATRTGSLGDVLADLTGAALALFAARSACRPD

SEQ ID NO: 40808 - DNA, 1205 bp, Neisseria meningitidis
atgtcaaacacaatcaaaatggttgtcggcttgggcaacccgggcaaagaatacgaacagacacgccacaatgcgggtttttggttcctcgacgaactggcgtggaaatggaaggcttcatttaaagaagaaaaaaaattcttcggcgaagtcgcccgtgccgccctgcccgacggcgacgtttggctgctcaaacctgccacgttcatgaaccgttccggacaggcagttgccgcgcttgcacagttctacaaaatcaaacccgaagaaatcctcgtcgtccacgacgaactcgacattccctgcggacggatcaaattcaaactcggcggcggcaacggcggacacaacggcttgaaagacattcaggcaaaactcggcacggcagactattaccgcctgcgcctcggcatcggccacccgggcgaccgcaacctcgtcgtcggctatgtcctgaacaaacccagtacggaacaccgccgacagattgacgatgccgtcgccaaatccctgcaagccatacccgacatccttgccggcaaatgggaagaagcaacccgcttcctgcacagcaaatgacccgatgccgtctgaagccctttcagacggcatgttcccgatttccatatccgaacagtcatgaccgaactcaagcagcttatccaaaccgaatccatccccgtcatcgaagaaaccctcgatttcctgctctacgaatgcagcatagacgatgccccctccgccgaagaaattgccgtttggcgcgatatgctggccgcacgcggcggaaaattcctgcgcctatccaaactatgccagacatggcttgaagaggaacaagcatgaatctgccacgcaaccgctttatcctgctctcggcattgtggtttgcaggcagcatttactcactgcttttcaaagctgccgaaaccgcgccaccgccttttccgcattttgacaaagtggcgcacctcgccctgtttttcgcacaaatctggcttctgaccaaagcattcagaaccgacaaccgccccatcccctatcgcagcctgatggtctttgccctctgtttcgccctcttcagcgaatgcgcgcaggcatggtttaccgcaacgagaaccggcagtttgggcgatgtccttgccgacctgacgggcgcagcccttgccctctttaccgcgcgagctgcctgccgcccggactaa

SEQ ID NO: 40809 - protein, 401 aa, Neisseria meningitidis
  misc_feature (159)..(159): Xaa can be any naturally occurring amino acid
  misc_feature (164)..(164): Xaa can be any naturally occurring amino acid
  misc_feature (277)..(277): Xaa can be any naturally occurring amino acid
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSTEXPPTDXRCRRQIPASHTRHPCRQMGRSNPLPAQQMTRCRLKPFQTACSRFPYPNSHDRTQAAYPNRIHPRHRRNPRFPALRMQHRRCPLRRRNCRLARYAGRTRRKIPAPIQTMPDMAXRGTSMNLPRNRFILLSALWFAGSIYSLLFKAAETAPPPFPHFDKVAHLALFFAQIWLLTKAFRTDNRPIPYRSLMVFALCFALFSECAQAWFTATRTGSLGDVLADLTGAALALFTARAACRPD

SEQ ID NO: 40810 - DNA, 1205 bp, Neisseria meningitidis
atgtcaaacacaatcaaaatggttgtcggcttgggcaacccgggcaaagaatacgaacagacacgccacaatgcgggtttttggttcctcgacgaactggcgtggaaatggaaggcttcatttaaagaagaaaaaaaattcttcggcgaagtcgcccgtgctaccctgcccgacggcgatgtctggctgctcaagccgaccacgttcatgaaccgttccggacaggcagttgccgcccttgcgcagttttataaaatcaaacccgaagaaatcctcgtcgtccacgacgaactcgacattccctgcggacggatcaaattcaaactcggcggcggcaacggtggacacaacggcttgaaagacattcaggcaaaactcggcacggcagactattaccgcctgcgcctcggcatcggccacccgggcgaccgcaacctcgtcgtcggctatgtcctgaacaaacccagtacggaacaccgccgacagattgacgatgccgtcgccaaatccctgcaagccatacccgacatccttgccggcaaatgtgaagaggcaacccgcttcctgcacagcaaatgacccgatgccgtctgaagccctttcagacggcatgttcccgatttccatatccgaacagtcatgaccgaactcaagcagcttatccaaaccgaatccatccccgtcatcgaagaaaccctcgatttcctgctgtacgaatgcagcatcgacgacgcaccatccgccgaagaagtggcacaatggcgcgacatacttgccgcacgcggcggcaaattcctgcgcctgtccaaaatctgccaaacgtggctggacgaggaggcggcatgaagctgccgcgcaaccgcttcagcctgctttccgcattgtggtttgccggcggcatctattcgctgctcttcaaagctgccgacaccgcgccgccgccgtttccgcatttcgacaaagcagcacaccttgccctgtttttcgcacaaatctggcttttgaccaaagcattcaaaaccggaaaacttcccatcccctaccgcagcctgatggtctttgccctctgtttcgccctcttcagcgaatgcgcgcaggcatgatttaccgcaacgagaaccggcagtttgggcgatgttcttgccgatatggcaggtacggttctcgcactctttgccgcccgcgccgccgaccgcccggactga

SEQ ID NO: 40811 - protein, 398 aa, Neisseria meningitidis
  misc_feature (159)..(159): Xaa can be any naturally occurring amino acid
MSNTIKMVVGLGNPGKEYEQTRHNAGFWFLDELAWKWKASFKEEKKFFGEVARATLPDGDVWLLKPTTFMNRSGQAVAALAQFYKIKPEEILVVHDELDIPCGRIKFKLGGGNGGHNGLKDIQAKLGTADYYRLRLGIGHPGDRNLVVGYVLNKPSTEXPPTDRCRRQIPASHTRHPCRQMRGNPLPAQQMTRCRLKPFQTACSRFPYPNSHDRTQAAYPNRIHPRHRRNPRFPAVRMQHRRRTIRRRSGTMARHTCRTRRQIPAPVQNLPNVAGRGGGMKLPRNRFSLLSALWFAGGIYSLLFKAADTAPPPFPHFDKAAHLALFFAQIWLLTKAFKTGKLPIPYRSLMVFALCFALFSECAQAFTATRTGSLGDVLADMAGTVLALFAARAADRPD

SEQ ID NO: 40812 - DNA, 975 bp, Neisseria gonorrhoeae
atgccgtctgaaaaaaatatcggttttatggcaggaagcagccgtccgttgcgggtcgcctttgcgctgttgctggtttcctgcatcctgtttatgacgctcaacgtcaaaggagattgggactttgtcttgcacctgcgcctgaccaagcttgccgcgctgctgatggtcgcctatgcggtcggcgtgtccactcaactcttccaaacgctgaccaacaacccgattctgaccccttcgattttgggtttcgattcgctgtatgtgtttttgcagaccttgctggtgtttacgttcggcggcgtgggctatacatccctgccgttgacgggcaaattcggctttgaactggttgttatgatgggcggctcgctgctgctgttttacacgctcatccgtcagggcgggcgcgatttgccgcacatgattttaatcggcgtgattttcgggattttgttccgcagcctttcctcgctgctttcgcgcatgatagaccccgaagaatttaccgccgcgcaggcgaatatgtttgccggattcaataccgtccgcagcgagcttttaggcataggcgcgctggtcctgctcgtcagcgcggcggtcgtttggcacgaacgctaccgctcggacgtacaccttttggggcgcgaccaagccgtcaatttgggcatcagctacacgcgcaacaccttatggatactgctttggattgccgcattggtggcgacggcgaccgccgttgtcggcccggtgagctttttcgggcttctcgccgcctcgcttgccaaccacttttccccgtccgtgcgccattccgtccgcctgccgatgacggtttgcgtcggcggcatcctcttggtcggcggacaaaccgtattcgaacacttcttgggcatgaaggcggtattaagcgtggtggtcgaatttgcgggcggactcgttttcctctatctcgttttaaaacacaaaaaatga

SEQ ID NO: 40813 - protein, 324 aa, Neisseria gonorrhoeae
MPSEKNIGFMAGSSRPLRVAFALLLVSCILFMTLNVKGDWDFVLHLRLTKLAALLMVAYAVGVSTQLFQTLTNNPILTPSILGFDSLYVFLQTLLVFTFGGVGYTSLPLTGKFGFELVVMMGGSLLLFYTLIRQGGRDLPHMILIGVIFGILFRSLSSLLSRMIDPEEFTAAQANMFAGFNTVRSELLGIGALVLLVSAAVVWHERYRSDVHLLGRDQAVNLGISYTRNTLWILLWIAALVATATAVVGPVSFFGLLAASLANHFSPSVRHSVRLPMTVCVGGILLVGGQTVFEHFLGMKAVLSVVVEFAGGLVFLYLVLKHKK

SEQ ID NO: 40814 - DNA, 975 bp, Neisseria meningitidis
atgccgtctgaaaaaaatatcggttttatggcaggaagcagccgcccgttgtgggtcgcctttgcgctgttgctggtttcctgcgtcctgtttatgacgctcaacgtcaaaggcgattgggattttgttttgcaactgcggctgaccaaacttgccgcgctgctgatggtcgcctatgcggtcggcgtgtccacgcaactcttccaaacgctgaccaataatccgattctgaccccttcaattttgggtttcgattcgctgtatgtgtttttgcagaccttgctggtgtttacgttcggcggcgtgggctatgcttccctgccgttgacgggcaaattcggctttgaactggtcgtcatgatgggcggctcgctgctgctgttctacacgctcatcaaacagggcggacgcgatttgtcgcgcatgattttaatcggcgtgattttcgggattttgttccgcagcctgtcgtcgctgctttcgcgcatgatcgatcccgaagaatttaccgccgcgcaggcgaatatgtttgccggattcaataccgtccacagcgagcttttgggcataggcgcgctgattctgctcgtcagcgcggcggtcgtttggcgcgaacgctaccgcttggacgtttaccttttggggcgtgaccaagccgtcaatttgggcatcagctacacgcgcaacaccttatggatactgctttggattgccgcattggtggcgacggcgaccgccgtggtcggccccgtaagctttttcgggcttctcgccgcctcgcttgccaaccacttttccccgtcggtcaaacattccgtccgcctgccgatgacggtttgtatcggcggcatcctcttggtcggcggacagaccgtgttcgaacacctgctcggtatgcaggcagtgttgagcgtagtagtagaatttgccggcggactcgttttcctctatctcgttttaaaacacaaaaaatga

SEQ ID NO: 40815 - protein, 324 aa, Neisseria meningitidis
MPSEKNIGFMAGSSRPLWVAFALLLVSCVLFMTLNVKGDWDFVLQLRLTKLAALLMVAYAVGVSTQLFQTLTNNPILTPSILGFDSLYVFLQTLLVFTFGGVGYASLPLTGKFGFELVVMMGGSLLLFYTLIKQGGRDLSRMILIGVIFGILFRSLSSLLSRMIDPEEFTAAQANMFAGFNTVHSELLGIGALILLVSAAVVWRERYRLDVYLLGRDQAVNLGISYTRNTLWILLWIAALVATATAVVGPVSFFGLLAASLANHFSPSVKHSVRLPMTVCIGGILLVGGQTVFEHLLGMQAVLSVVVEFAGGLVFLYLVLKHKK

SEQ ID NO: 40816 - DNA, 975 bp, Neisseria meningitidis
atgccgtctgaaaaaaatatcggttttatggcaggaagcagccgtccgttgtgggttgcctttgcgctgttgctggtttcctgcatcctgtttatgacgctcaacgtcaaaggcgattgggattttgttttgcacctgcgcctgaccaagcttgccgcgctgctgatggtcgcctatgcggtcggcgtttcgacccagctttttcaaacgctgaccaacaatccgattctgaccccttcgattttgggtttcgattcgctgtatgtgtttttgcagaccttgctggtgtttacgttcggcggcgtgggctatgcttccctgccgttgacgggcaaattcggctttgaactggtcgttatgatgggcggctcgctgctgctgttttacacgctcatcaaacagggcgggcgcgatttgccgcgtatgattttaatcggcgtgattttcgggattttgttccgcagcctgtcgtcgctgctttcgcgcatgatcgaccccgaagaatttacggcggcgcaggcgaatatgtttgccggattcaataccgtccacagcgagcttttaggcataggcgcgctgattctgctcgtcagcgcggcggtcgtttggcgcgaacgctaccgcttggacgtacaccttttggggcgcgaccaagccataaatttgggcatcagctacacgcgcaacaccttatggatactgctttggattgccgcgctggtggcgacggcgaccgccgttgtcggcccggtaagctttttcgggcttctcgccgcctcgcttgccaaccacttttccccgtcggtcaaacattccgtccgcctgccgatgacggtttgtgtcggcggcatcctcttggtcggcggacagaccgtattcgaacacttcttgggcatgaaggcggtattaagcgtggtggtcgaatttgcgggcggactcgttttcctctatctcgttttaagacacaaaaaatga

SEQ ID NO: 40817 - protein, 324 aa, Neisseria meningitidis
MPSEKNIGFMAGSSRPLWVAFALLLVSCILFMTLNVKGDWDFVLHLRLTKLAALLMVAYAVGVSTQLFQTLTNNPILTPSILGFDSLYVFLQTLLVFTFGGVGYASLPLTGKFGFELVVMMGGSLLLFYTLIKQGGRDLPRMILIGVIFGILFRSLSSLLSRMIDPEEFTAAQANMFAGFNTVHSELLGIGALILLVSAAVVWRERYRLDVHLLGRDQAINLGISYTRNTLWILLWIAALVATATAVVGPVSFFGLLAASLANHFSPSVKHSVRLPMTVCVGGILLVGGQTVFEHFLGMKAVLSVVVEFAGGLVFLYLVLRHKK

SEQ ID NO: 40818 - DNA, 495 bp, Neisseria gonorrhoeae
atgaagaaaaccctgttggcaattgttgccgttttcgccttaagtgcctgccggcaggcggaagaggcaccgccgcctttaccccggcagattagcgaccgttcggtcggacactattgcagtatgaacctgaccgaacacaacggccccaaagcccagatttttttgaacggcaaacccgatcagcccgtttggttctccaccgtcaagcagatgttcggctataccaagctgcccgaagagcccaaaggcatccgcgtgatttacgttaccgatatgggcaatgttaccgattggacgaatcctaatgccgacacggagtggatagatgcgaaaaaagccttttacgtcatcgacagcggctttatcggcggtatgggcgcggaagacgcgctgccgttcggcaacaaggagcaggctgaaaaatttgcaaaggataaaggcggcaaggtcgtcggttttgacgatatgcccgatgcttacattttcaagtaa

SEQ ID NO: 40819 - protein, 164 aa, Neisseria gonorrhoeae
MKKTLLAIVAVFALSACRQAEEAPPPLPRQISDRSVGHYCSMNLTEHNGPKAQIFLNGKPDQPVWFSTVKQMFGYTKLPEEPKGIRVIYVTDMGNVTDWTNPNADTEWIDAKKAFYVIDSGFIGGMGAEDALPFGNKEQAEKFAKDKGGKVVGFDDMPDAYIFK

SEQ ID NO: 40820 - DNA, 495 bp, Neisseria meningitidis
atgaaaaaaaccctgttggcaattgttgccgtttccgccttaagtgcctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataa

SEQ ID NO: 40821 - protein, 164 aa, Neisseria meningitidis
MKKTLLAIVAVSALSACRQAEEGPPPLPRQISDRSVGHYCSMNLTEHNGPKAQIFLNGKPDQPVWFSTIKQMFGYTKLPEEPKGIRVIYVTDMGNVTDWTNPNADTEWMDAKKAFYVIDSGFIGGMGAEDALPFGNKEQAEKFAKDKGGKVVGFDDMPDTYIFK

SEQ ID NO: 40822 - DNA, 495 bp, Neisseria meningitidis; identical to SEQ ID NO: 40820

SEQ ID NO: 40823 - protein, 164 aa, Neisseria meningitidis; identical to SEQ ID NO: 40821

SEQ ID NO: 40824 - DNA, 1248 bp, Neisseria gonorrhoeae
atgcaacttaccgctgtcggactcaatcatcaaaccgcacctttaagcatacgggaaaagctggcgtttgccgccgccgccctgccagaagccgtccgcaatcttgcccgaagcaatgcggcaacggaggcggtaatcctttctacctgcaaccgcaccgagctttactgcgtcggcgattcggaagaaatcatccgatggcttgccgattaccacagtttgccgattgaagaaatccgtccgtatctgtacacgctggatatgcaggaaaccgtgcgccacgccttccgcgttgcctgcggcttggattcgatggttttgggcgagccgcagattttggggcagattaaagatgcggtgcgtgcggctcaagaacaggaaagtatgggggcaaaactcaatgccctgttccaaaaaaccttttccgttgctaaagaagtccgtaccgataccgctgtcggcgaaaattcggtttcgatggcttccgcgtccgtcaagttggcggaacagatttttcccgacatcggcgatttgaacgtattgtttatcggcgcaggcgaaatgattgagctggttgccacttattttgccgccaaaaatccccggctgatgacggttgccaaccggacgctggcgcgtgcacaggagttgtgcgacaagctcggtgttaacgccgaaccgtgcctgctgtccgatctgcctgccattctgcacgattacgacgtggtggtttcttcaacggcgagccagcttccgatagtcggcaaaggcatggtcgaacgcgcattgaaacagcgtcagagtatgccgttgttcatgcttgacttggccgtgccgcgcgatattgaagcggaagtcggcgatttgaacgatgcgtatctttatacggtggacgatatggtcaacatcgtccaaagcggcaaggaggcaaggcagaaagccgccgccgccgccgaaacgctggtgtccgaaaaggttgccgaatttgtcaggcagcagcagggcaggcagagcgttccgctgattaaggccttgcgggacgagggcgagaaagcgcgcaagcaggtgttggaaaatgcgatgaaacagcttgccaaaggcgcaacggcggaagaggttttggaacggctgtccgtccaactgaccaacaagctgctgcattcgccaactcaaaccttgaataaggcgggggaagaagataaagatttggttcatgccgtcgcgcagatttatcatttggacaaataa

SEQ ID NO: 40825 - protein, 415 aa, Neisseria gonorrhoeae
MQLTAVGLNHQTAPLSIREKLAFAAAALPEAVRNLARSNAATEAVILSTCNRTELYCVGDSEEIIRWLADYHSLPIEEIRPYLYTLDMQETVRHAFRVACGLDSMVLGEPQILGQIKDAVRAAQEQESMGAKLNALFQKTFSVAKEVRTDTAVGENSVSMASASVKLAEQIFPDIGDLNVLFIGAGEMIELVATYFAAKNPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 40826 - DNA, 1248 bp, Neisseria meningitidis
atgcaacttaccgctgtcggactcaatcatcaaaccgcacctttaagcatacgggaaaagctggcgtttgccgccgccgccctgcctaaagccgtccgcaatcttgcccgaagcaatgcggcaacggaggcggtaatcctttctacctgcaaccgcaccgagctttactgcgtcggtgattcggaagaaatcatccgatggcttgccgattaccacagtttgccgattgaagaaatccgtccgtatctgtacgcgctggatatgcaggagactgtgcgccatgctttccgcgtcgcctgcgggctggattcgatggtgttgggcgagccgcagattttaggacagattaaggatgccgttagggttgctcaagagcaggaaagtatgggtaagaaactcaatgccctgttccaaaaaaccttttccgttgctaaagaggtccgtaccgatactgccgtcggcgaaaactcggtttccatggcttccgcttccgtcaaattggcggaacagatttttcccgacatcggcgatttgaatgtcttgtttatcggcgcaggcgaaatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattctgcacgattacgacgtagtggtttcttcaacggcaagccagttgcccattgtcggcaaaggcatggtggagcgtgcattgaaacaaaggcagagtatgccgttgttcatgcttgatttggcagtgccgcgtgacattgaagcggaagtcggcgatttgaatgatgcctatctttatacggtggacgatatggtcaatatcgtccaaagcggcaaggaggcaaggcagaaggccgccgccgccgccgaaacgctggtgtccgagaaagttgccgaatttgtcaggcagcagcagggcaggcagagtgtccccttgattaaggcgttgcgggacgagggcgagaaagcgcgcaaacaggtgttggaaaatgccatgaaacagcttgccaaaggcgcaacggcagaagaggttttggaacggctgtccgtccaactgaccaacaagctgctgcattcgccgacccaaaccttgaataaggcgggggaagaagataaagatttggttcatgccgtcgcgcagatttatcatttggacaaataa

SEQ ID NO: 40827 - protein, 415 aa, Neisseria meningitidis
MQLTAVGLNHQTAPLSIREKLAFAAAALPKAVRNLARSNAATEAVILSTCNRTELYCVGDSEEIIRWLADYHSLPIEEIRPYLYALDMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 40828 - DNA, 1248 bp, Neisseria meningitidis
atgcaacttaccgctgtcggactcaatcatcaaaccgcacctttaagcatacgggaaaagctggcgtttgccgcggcctgcctgcccgaagccgtccgcaatcttgcccgaagcaatgcggcaacggaggcggtaatcctttctacctgcaaccgtaccgagctttactgtgtaggtgattcggaagaaatcatccgttggctcgcagactatcacagccttcccatagaagaaatcagcccctacctttatactttggggatgcaggagactgtgcgccatgctttccgcgtcgcctgcggcttggattcgatggtgttgggcgagccgcagattttaggacagattaaggatgcggtcagggttgctcaagagcaggaaagtatgggtaagaaactcaatgccctgttccaaaaaaccttttctgttgctaaagaggtccgtaccgatactgccgtcggcgaaaactcggtttccatggcttccgcttccgtcaagttggcagagcagattttccccgacatcggcgatttgaatgtcttgtttatcggtgcgggtgagatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattttgcatgagtacgacgtggtggtttcttcaacggcaagccagttgcccattgtcggcaaaggtatggtggagcgcgcattgaaacaaaggcagagtatgccgttgtttatgcttgacttggccgtgccgcgagacattgaggcggaagtcggagatttgaacgatgcctatctttatacggtggacgatatggtcaatatcgtccaaagcggcaaggaggcaaggcagaaggccgccgccgccgccgaaacgctggtgtccgagaaggttgccgaatttgtcaggcagcagcagggcaggcagagtgtcccgttaatcagggcattgagggatgagggagagaaagcgcgcaaacaggtcttggaaaatgcgatgaaacagcttgccaaaggcgcaacggcagaagaggttttggaaaggctgtcgatccaactgaccaacaagctgctgcattcgccgacccaaaccttgaataaggcgggggaagaagataaagatttggttcacgccgtcgcgcagatttatcatttggacaaataa

SEQ ID NO: 40829 - protein, 415 aa, Neisseria meningitidis
MQLTAVGLNHQTAPLSIREKLAFAAACLPEAVRNLARSNAATEAVILSTCNRTELYCVGDSEEIIRWLADYHSLPIEEISPYLYTLGMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHEYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIRALRDEGEKARKQVLENAMKQLAKGATAEEVLERLSIQLTNKLLHSPTQTLNKAGEEDKDLVHAVAQIYHLDK

SEQ ID NO: 40830 - DNA, 360 bp, Neisseria gonorrhoeae
  misc_feature (284)..(284): n is a, c, g, or t
atgatccgttatcttttaattgcctgcggcggcatctccctgctgttggggataatcggcatttttttgccgctgttgccgaccacgccgttcgtactactctccgccgcctgctgggcaaaggcatccccgcgctttcaccgctggctgcaccggcaccgctatttcggcccgatggttcataactgggaacaaaacggcgcagtgccgcgcaaagccaagattttcgccatcagcatgataaccgcatcctgcctcatgatcttttggcattttccccaacnctggtgggtcggggcggtttcatcggttttttgttcccttgtcaccatacggatgtggcacagacccgaatcttga

SEQ ID NO: 40831 - protein, 119 aa, Neisseria gonorrhoeae
  misc_feature (95)..(95): Xaa can be any naturally occurring amino acid
MIRYLLIACGGISLLLGIIGIFLPLLPTTPFVLLSAACWAKASPRFHRWLHRHRYFGPMVHNWEQNGAVPRKAKIFAISMITASCLMIFWHFPQXWWVGAVSSVFCSLVTIRMWHRPES

SEQ ID NO: 40832 - DNA, 360 bp, Neisseria meningitidis
atgatacgttatcttttaattgcctgcggctgcatttccctactgttgggtatcatcggcatttttttgccgctgttgccgaccacgccgttcgtactgctctccgccgcctgctgggcaaaggcatccccgcgcttttaccgctggctgcaccggcaccgctatttcggcccgatggttcataactgggaacaaaacggcgcagtgccgcgcaaagccaaaatattcgccatcagtatgatgaccgcatcctgcctgataatgttttggcagtttccccaacgctggtgggtcggggcggtttcatcggttttttgttcccttgtcgccatatggatgtggcgcaggcccgaatcttga

SEQ ID NO: 40833 - protein, 119 aa, Neisseria meningitidis
MIRYLLIACGCISLLLGIIGIFLPLLPTTPFVLLSAACWAKASPRFYRWLHRHRYFGPMVHNWEQNGAVPRKAKIFAISMMTASCLIMFWQFPQRWWVGAVSSVFCSLVAIWMWRRPES

SEQ ID NO: 40834 - DNA, 360 bp, Neisseria meningitidis
atgatacgttatcttttaattgcctgcggctgcatttccctgctgttgggtatcatcggcatttttttgccgctgttgccgaccacgccgttcgtactgctctccgccgcctgctgggcaaaggcatccccgcgctttcaccgctggctgcaccggcaccgctatttcggtccgatggttcataactgggaacaaaacggcgcagtgccgcgcaaagccaaaatattcgccatcagtatgatgaccgcatcctgcctgataatgttttggcagtttccccaacgctggtgggtcggggcggtttcatcggttttttgttcccttgtcgccatatggatgtggcgcaggcccgaatcttga

SEQ ID NO: 40835 - protein, 119 aa, Neisseria meningitidis
MIRYLLIACGCISLLLGIIGIFLPLLPTTPFVLLSAACWAKASPRFHRWLHRHRYFGPMVHNWEQNGAVPRKAKIFAISMMTASCLIMFWQFPQRWWVGAVSSVFCSLVAIWMWRRPES

SEQ ID NO: 40836 - DNA, 354 bp, Neisseria meningitidis
atgtttgcaaccaggaaaatgaagaagatgacgatgtgcacgcggcgggtacggttttggttggctttcagcagcggacgaatcatcagcattgctgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaagggatgtattcttcaacgagtgcgtgtgcgacggtatggataccggcggacgcgccaaaaaccaaactgaacgggatgaggaagagcaatgtccaaaaggcggtaattttgccgtaa

SEQ ID NO: 40837 - protein, 117 aa, Neisseria gonorrhoeae
MFATRKMKKMTMCTRRVRSWLAFSSGRIISIAAPVVPMIEASAVPTASRAVLSLGVPFKSPQTKMPPEMVYRASSSRMKGIYSSTSACATVWIPADAPKTKLNGMRKSNVQKAVILP

SEQ ID NO: 40838 - DNA, 354 bp, Neisseria meningitidis; identical to SEQ ID NO: 40836

SEQ ID NO: 40839 - protein, 117 aa, Neisseria meningitidis
MFATRKMKKMTMCTRRVRFWLAFSSGRIISIAAPVVPMIEASAVPTASRAVLSLGVPFKSPQTKMPPEMVYRASSSRMKGMYSSTSACATVWIPADAPKTKLNGMRKSNVQKAVILP

SEQ ID NO: 40840 - DNA, 354 bp, Neisseria gonorrhoeae
atgtttgcaaccaggaaaatgaagaagatgacgatgtgcacgcggcgggtacggtcttggttggctttcagcagcggacgaatcatcagcattgccgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaggggatatattcttcaacgagtgcgtgtgcgacggtatggataccggcggacgcgccaaaaaccaaactgaacgggatgaggaagagcaatgtccaaaaggcggtgattttgccgtaa

SEQ ID NO: 40841 - protein, 117 aa, Neisseria meningitidis; identical to SEQ ID NO: 40839

SEQ ID NO: 40842 - DNA, 633 bp, Neisseria gonorrhoeae
atgtccggcctttggaaacccgaacacccgggatttgaaatcctcggcagccgttacgccctgcaaaaccttgtccgcgatgtcatcctgattacattgaccgccgtatctatggcaatcacgcccaaacaagtccgcgcaggcaacgaattcaactttgaacccatcgccgaagtgggcaaactcttcctcggcatcttcatcaccatcttccccgtcctgagcattctgaaagcaggcgaggcaggcgcgctgggcggggtggtatcgctggttcacgatacggcaggtcatccgattaatacgatgtatttctggatgagcggcatattgtcggcattcttggataacgcgcccacttatctcgtgtttttcaatatggcgggcggcgatgcccaagccttaatgacgggtcccctgtttcattcgctgctggcggtttctatgggttcggtattcatgggcgcactgacctacatcggcaacgcaccgaacttcatggtcaaggccattgccgaacagcgcggcgtaccgatgccgactttcttccggtatatgatgtggtcggtcgccttcctgacacccgtcttcatcgtacataccctcgtctttttcgttttcaaactactgtaa

SEQ ID NO: 40843 - protein, 210 aa, Neisseria gonorrhoeae
MSGLWKPEHPGFEILGSRYALQNLVRDVILITLTAVSMAITPKQVRAGNEFNFEPIAEVGKLFLGIFITIFPVLSILKAGEAGALGGVVSLVHDTAGHPINTMYFWMSGILSAFLDNAPTYLVFFNMAGGDAQALMTGPLFHSLLAVSMGSVFMGALTYIGNAPNFMVKAIAEQRGVPMPTFFRYMMWSVAFLTPVFIVHTLVFFVFKLL

SEQ ID NO: 40844 - DNA, 633 bp, Neisseria meningitidis
atgtccggcctttggaaacccgaacacccgggatttgaaatcctcggcagccgttacgccctgcaaaacctcgtccgcgatgtcatcctgattgcattgaccgccgtatctatggcaatcacgcccaaacaagtccgcgcaggcaacgaattcaactttgaacccatcgccgaagtgggcaaactcttcctcggcatcttcatcaccatctttcccgtcctgagcattctgaaagcaggcgaggcaggcgcgctgggcggggtggtatcgctggttcacgatacggcaggtcatccgattaatgtgatgtatttttggatgagcggcatattgtcggcattcttggataacgcgcccacttatctcgtttttttcaatatggcgggcggcgatgcccaagccttgatgacgggtaccctgtttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacatacccttatctttttcgttttcaaactgctgtaa

SEQ ID NO: 40845 - protein, 210 aa, Neisseria meningitidis
MSGLWKPEHPGFEILGSRYALQNLVRDVILIALTAVSMAITPKQVRAGNEFNFEPIAEVGKLFLGIFITIFPVLSILKAGEAGALGGVVSLVHDTAGHPINVMYFWMSGILSAFLDNAPTYLVFFNMAGGDAQALMTGTLFHSLLAVSMGSVFMGALTYIGNAPNFMVKAIAEQRGVPMPTFFGYMMWSVAFLTPVFIVHTLIFFVFKLL

SEQ ID NO: 40846 - DNA, 633 bp, Neisseria meningitidis
atgtccggcctttggaaacccgaacacccgggatttgaaatcctcggcagccgttacgccctgcaaaacctcgtccgcgatgtcatcctgattgcattgaccgccgtatctatggcaatcacgcccaaacaagtccgcgcaggcaacgaattcaactttgaacccatcgccgaagtgggcaaactcttcctcggcatcttcatcaccatctttcccgtcctgagcattctgaaagcaggcgaggcaggcgcgctgggcggggtggtatcgctggttcacgatacggcaggtcatccgattaatgtgatgtatttttggatgagcggcatattgtcggcattcttggataacgcgcccacttatctcgtttttttcaatatggcgggcggcgatgcccaagccttgatgacgggttccctgtttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacatacccttatctttttcgttttcaaactgctgtaa

SEQ ID NO: 40847 - protein, 210 aa, Neisseria meningitidis
MSGLWKPEHPGFEILGSRYALQNLVRDVILIALTAVSMAITPKQVRAGNEFNFEPIAEVGKLFLGIFITIFPVLSILKAGEAGALGGVVSLVHDTAGHPINVMYFWMSGILSAFLDNAPTYLVFFNMAGGDAQALMTGSLFHSLLAVSMGSVFMGALTYIGNAPNFMVKAIAEQRGVPMPTFFGYMMWSVAFLTPVFIVHTLIFFVFKLL

SEQ ID NO: 40848 - DNA, 363 bp, Neisseria gonorrhoeae
atgtgcgtgccactcaagccggcaggatgcgggccgccaaattcatgtgtttcgatattggcagcattttcagacggcacgtctgcgcctgctgctttacacacatggattttacgttcggtcaggcggctcaataccaacaggccgcgtttgaagtcttcggcggcttctttgatgatgaccgtagggtcggcagccagcggattggtgtccatcgcattgacgaagatggcgaacggctcggcatctacggcagggattttgctgaacggacgggtgcgaagcgcagtccataagcctgattgaatcaggttgcggcgcactttttcgctgctcaattttgccagcgcttcaggtacgtag

SEQ ID NO: 40849 - protein, 119 aa, Neisseria gonorrhoeae
MCVPLKPAGCGPPNSCVSILAAFSDGTSAPAALHTWILRSVRRLNTNRPRLKSSAASLMMTVGSAASGLVSIALTKMANGSASTAGILLNGRVRSAVHKPDIRLRRTFSLLNFASASGT

SEQ ID NO: 40850 - DNA, 363 bp, Neisseria meningitidis
atgtgcgtgccactcaaaccggcaggatgcgggccgccgaattcatgtgtttcgatgttggcagcattttcagacggcacgtctgcgccagctgccttacaaacatggattttgcgttcggtcaaacggctcaataccaacaggccgcgtttgaaatcctcggcggcttctttgataatgaccgtagggtcggcagccagcggattggtgtccatcgcattgacgaagatggcgaacggctcggcatcgacggcaggaattttgctgaacggacgggtgcgcagcgcagtccacaaaccggattggatcaggttgcggcgcacttcttcgccgcttaagtttgccagcgcttcaggtgcgtag

SEQ ID NO: 40851 - protein, 120 aa, Neisseria meningitidis
MCVPLKPAGCGPPNSCVSMLAAFSDGTSAPAALQTWILRSVKRLNTNRPRLKSSAASLIMTVGSAASGLVSIALTKMANGSASTAGILLNGRVRSAVHKPDWIRLRRTSSPLKFASASGA

SEQ ID NO: 40852 - DNA, 363 bp, Neisseria meningitidis
atgtgcgtgccactcaaaccggccggatgcgggccgccgaattcatgtgtttcgatgttggcagcattttcagacggcacgtctgcgccagctgccttacacacatggattttacgctcggtcaaacggctcaataccagcaaacctcgtctgaaatcctcggcggcttctttgatcacaaccacagggtctgccgccagcggattggtgtccatcgcattgacgaagatggcgaacggctcggcatcgacggcagggattttgctgaacggacgggtacgcagcgcagtccacaaaccggattggatcagattgcggcgcacttcttcgccgcttaagtttgccaacgcttcgggcgcgtag

SEQ ID NO: 40853 - protein, 120 aa, Neisseria meningitidis
MCVPLKPAGCGPPNSCVSMLAAFSDGTSAPAALHTWILRSVKRLNTSKPRLKSSAASLITTTGSAASGLVSIALTKMANGSASTAGILLNGRVRSAVHKPDWIRLRRTSSPLKFANASGA

SEQ ID NO: 40854 - DNA, 968 bp, Neisseria gonorrhoeae
atgactgccaaacctttttccctcaacctggccaacctcctgctgccggcggtattgtttgccgtcagcctgtcggtcggcattgccgatttccgctggtcggatgtgttttcgctgtccgacagccagcaagtgatgttcatcagccgcctgccgcgcacgtttgcgattgtgttgacgggcgcgtcgatagcggtggcggggatgattatgcagattctgatgcgcaaccgttttgtcgagccttctatggcgggtgcgggccaaagtgcggctttgggtttgcttctgatgtccctgctgctgcctgccgcgccgctgccggtcaaaatgtcggtagccgccgttgccgcgctgatcgggatgttggtctttatgctgctaatccgccgcctgccaccgacggcgcagctgatggtgccgctggtggggttattttcggcggcgtggttgaggcggtggcgacgtttgtcgcgtatgagtttgagatgctgcaaatgttgggcgtgtggcagcagggcgacttttcaagcgtgctgctggggcggtacgagctgctttggattacgggcggtttggcggtgtttgcctacctgattgccgaccggctgacgattttggggctgggcgagacggtgagcgtgaatttgggtttgaaccggacggcggtgttgtggtcgggtttgattattgtggcactgattacatcgctggtcattgtaacggtcggcaatattccgtttatcgggctggtcgtgccgaatatcgtcagccgcctgatgggcgacaggctgcgccaaagcctgcctgcggtcgccctcttgggcgcgtctttggttttattgtgcgacattatcggacgcatgattgtgtttccgtttgaaattccggtctccacggtttttggtgtgttgggtacggctttgtttttgtggcttttgttgaggaaacccgcctatgccgtctga

SEQ ID NO: 40855 - protein, 322 aa, Neisseria gonorrhoeae
  misc_feature (145)..(145): Xaa can be any naturally occurring amino acid
MTAKPFSLNLANLLLPAVLFAVSLSVGIADFRWSDVFSLSDSQQVMFISRLPRTFAIVLTGASIAVAGMIMQILMRNRFVEPSMAGAGQSAALGLLLMSLLLPAAPLPVKMSVAAVAALIGMLVFMLLIRRLPPTAQLMVPLVGXIFGGVVEAVATFVAYEFEMLQMLGVWQQGDFSSVLLGRYELLWITGGLAVFAYLIADRLTILGLGETVSVNLGLNRTAVLWSGLIIVALITSLVIVTVGNIPFIGLVVPNIVSRLMGDRLRQSLPAVALLGASLVLLCDIIGRMIVFPFEIPVSTVFGVLGTALFLWLLLRKPAYAV

SEQ ID NO: 40856 - DNA, 969 bp, Neisseria meningitidis
atgactgccaaacctttttccctcaacctgaccaacctgctgctgctggcggtgttgtttgccgtcagcctgtcggtgggcgttgccgatttccgctggtctgatgtgttttcactgtccgacagccagcaggtcatgttcatcagccgcctgccgcgcacgtttgcgattgtgctgacgggcgcgtcgatggcggtggccggcatgattatgcagattttgatgcgcaaccgttttgtcgaaccgtcgatggtgggcgcaagccaaagcgcggctttaggtttgctgctgatgaccctgctgctgccggccgcgccgctgccggcgaaaatgtcggttgccgccgttgccgcgctgatcgggatgttggtctttatgctgctgatccgccgcctgccgccgaccgcgcaactgatggtgcctttggtcgggattattttcggcggtgtgattgaggcggtagccacctttatcgcgtatgaaaacgaaatgctgcaaatgctcggcgtgtggcagcagggcgatttttcgagcgtgctgctggggcggtacgagctgctttggattacgggcggtttggcggtgtttgcctatctgattgccgaccggctgacgattttggggctgggcgaaacggtaagcgtgaatttgggtttgaaccggacggcggtgttgtggtcgggtttgattattgtggctttgattacgtcgctggttatcgttacggtcggcaatattccgtttatcgggctggtcgtgccgaacatcatcagccgcctgatgggcgacaggttgcgccaaagcctgcctgcggtggccttgctgggcgcatctttggtgttgctgtgcgacattatcggacgcgtgattgtgtttccgtttgaaattccggtctctacggtttttggtgtattgggtacggctttgtttttgtggcttttgttgaggaaacccgcctatgccgtctga

SEQ ID NO: 40857 - protein, 322 aa, Neisseria meningitidis
MTAKPFSLNLTNLLLLAVLFAVSLSVGVADFRWSDVFSLSDSQQVMFISRLPRTFAIVLTGASMAVAGMIMQILMRNRFVEPSMVGASQSAALGLLLMTLLLPAAPLPAKMSVAAVAALIGMLVFMLLIRRLPPTAQLMVPLVGIIFGGVIEAVATFIAYENEMLQMLGVWQQGDFSSVLLGRYELLWITGGLAVFAYLIADRLTILGLGETVSVNLGLNRTAVLWSGLIIVALITSLVIVTVGNIPFIGLVVPNIISRLMGDRLRQSLPAVALLGASLVLLCDIIGRVIVFPFEIPVSTVFGVLGTALFLWLLLRKPAYAV

SEQ ID NO: 40858 - DNA, 969 bp, Neisseria meningitidis
atgactgccaaacctttttccctcaacctgactaacctcctgctgctggcggtgttgtttgccgtcagcctgtcggtgggcgttgccgatttccgctggtcggatgtgttttcgctgtcggacagccagcaggttatgttcatcagccgcctgccgcgcacgtttgcgattgtgttgacgggcgcgtcgatggcggtggcggggatgattatgcagattctgatgcgtaaccgttttgtcgagccttctatggcgggcgcgggtcagagtgcggctttgggtttgcttctgatgtccctgctgctgcctgccgcgccgctgccggtcaaaatgtcggttgccgccgttgccgcgttaatcgggatgttggtgtttatgatgcttatccgccgcctgccgccgacggcgcaactgatggtgcctttggtcgggattattttcggcggcgtggttgaggcggtggccacctttattgcgtatgaaaacgaaatgctgcaaatgctgggcgtgtggcaacagggcgatttttccggcgtgttgctcggacggtatgaactgttgtgggcaacggggattttggctttgtttgcctatttgattgccgaccagctgacgattttgggtttgggcgaaacggtaagcgtgaacttggggctgaaccggacggcgattctgtggtcggggctgattattgtggctttgattacgtcgctggttatcgttacggtcggcaatattccgtttatcgggctggtcgtgccgaacatcatcagccgcctgataggcgacaggctgcgccaaagcctgcctgcggtggctttgctgggtgcgtctttggttttattgtgcgacattatcggacgagtgattgtgtttccgtttgaaattccggtatcgaccgtcttcggcgtattgggtacggcgttgtttttatggcttttgttaaggaaacctgctcatgccgtctga

SEQ ID NO: 40859 - protein, 322 aa, Neisseria meningitidis
MTAKPFSLNLTNLLLLAVLFAVSLSVGVADFRWSDVFSLSDSQQVMFISRLPRTFAIVLTGASMAVAGMIMQILMRNRFVEPSMAGAGQSAALGLLLMSLLLPAAPLPVKMSVAAVAALIGMLVFMMLIRRLPPTAQLMVPLVGIIFGGVVEAVATFIAYENEMLQMLGVWQQGDFSGVLLGRYELLWATGILALFAYLIADQLTILGLGETVSVNLGLNRTAILWSGLIIVALITSLVIVTVGNIPFIGLVVPNIISRLIGDRLRQSLPAVALLGASLVLLCDIIGRVIVFPFEIPVSTVFGVLGTALFLWLLLRKPAHAV

SEQ ID NO: 40860 - DNA, 852 bp, Neisseria gonorrhoeae
atgatgattttggtgtggctggctttgtttccccccatgttttacggcatgtacaacgtcggcgcacaggcattcggtgccttaacgcccgatttgctgcaacaaagcatcgcccacgacggcaattacgccctcgccaacgctttgggcatcaatatgtcccccgaagcgggcgtgttgggcaaaatgctgttcggcgcgatttacttcctgccgatttacgcgaccgtatttattgtgggcggcttctgggaagtcttgttcgcatccgtacgcaaacacgaaatcaacgaaggtttcttcgttacttcgattctgtttgccttaatcgttccgcccacgctgccgctgtggcaggcggctttgggtatttctttcggcgttgtggttgcgaaagaagtattcggcggtacaggtaaaaacttcatgaaccctgcgctggcaggccgcgccttcctgttcttcgcctaccccgccaacttgagcggcgatgcggtttggacggcggttgacggctattccggcgcaaccgcgctggcgcaatgggcggcacacggtgcagacggcctgaaaaacgccgtaaccggtcaaaccatcacttggatggacgcgtttatcggcaaactgcccggctccatcggcgaagtctccactttggcactcttaatcggcggcgcgtttatcgtgtttgcccgcatcgcttcttggcgcattattgccggcgtgatgatcggtatgattgcgatgtcttcgctgattaacttcatcggttctgacaccaaagctatgtttgctatgcacttggtacatggcacttggtggaaagatgattatcactcactgtacattaaa

SEQ ID NO: 40861 - protein, 284 aa, Neisseria gonorrhoeae
MMILVWLALFPPMFYGMYNVGAQAFGALTPDLLQQSIAHDGNYALANALGINMSPEAGVLGKMLFGAIYFLPIYATVFIVGGFWEVLFASVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLINFIGSDTKAMFAMHLVHGTWWKDDYHSLYIK

SEQ ID NO: 40862 - DNA, 1068 bp, Neisseria meningitidis
atgatgattttggtgtggctggctttgttccctgccatgttctacggtatgtacaacgtcggcgcgcaggcattcggtgcgttaacgcctgatttgctgcaacaaaacatcgccaacgactggcattacgcctttgccaacgctttgggcatcaatatgtcgtctgaagcgggcgtgtcggacaaaatgctgtttggcgcgatttacttcctgccgatttacgcgactgtatttgttgtgggcggtttctgggaagttttgttcgccaccgtgcgcaaacacgaaatcaacgaaggtttcttcgttacttcgattctgtttgccttaatcgttccgcccacgctgccgctgtggcaggcggctttgggtatttctttcggcgttgtggttgcgaaagaagtattcggcggtacaggtaaaaacttcatgaaccctgcgctggcaggccgtgctttcctgttcttcgcctaccctgccaacttgagcggcgatgcggtttggacggcggttgacggctattccggcgcaaccgcactggcgcaatgggcggcacacggtgcagacggcctgaaaaacgccgtaaccggtcaaaccatcacttggatggacgcgtttatcggcaaactgcccggctccattggcgaagtctccactttggcactcttaatcggcggcgcgtttatcgtgtttgcccgcatcgcttcttggcgcattattgccggcgtgatgatcggtatgattgcgatgtcttcgctgttcaacttcatcggttcggacaccaacgctatgtttgctatgccttggtactggcacttggtggtcggcggcttcgccatcggtatgctgtttatggcgaccgaccctgtttccgcttcctttaccaatgtcggcaaatggtggtacggcgcactgatcggtgtgatgtgcgtattaatccgcgtggtcaatccggcttaccccgaaggcatgatgttggcgattctgtttgccaacctgtttgccccgattttcgactatttcgtcgcacaagcgaacatcaaacgcagaaaggcgcgcagcaatggctaa

SEQ ID NO: 40863 - protein, 355 aa, Neisseria meningitidis
MMILVWLALFPAMFYGMYNVGAQAFGALTPDLLQQNIANDWHYAFANALGINMSSEAGVSDKMLFGAIYFLPIYATVFVVGGFWEVLFATVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVVNPAYPEGMMLAILFANLFAPIFDYFVAQANIKRRKARSNG

SEQ ID NO: 40864 - DNA, 1068 bp, Neisseria meningitidis
atgatgattttggtgtggctggctttgttccctgccatgttctacggtatgtacaacgtcggcgcacaggcattcggtgcgttaacgcccgatttgctgcaacaaagcatcgccaacgactggcattacgcccttgccaacgctttgggcatcaatatgtcgtctgaagcgggcgtgttgggcaaaatgctgttcggcgcgatttacttcctgccgatttacgcgaccgtatttattgtcggcggtttctgggaagttttgttcgccaccgtgcgcaaacatgaaatcaacgaaggtttctttgttacctcgattctgtttgccttaatcgttccgcccacgctgccgctgtggcaggcagctttgggtatttctttcggcgttgtggttgcgaaagaagtattcggcggtacaggtaaaaacttcatgaaccctgcgctggcaggccgtgccttcctgttcttcgcctaccctgccaacttgagcggcgatgcggtttggacggcggttgacggctattccggcgcaaccgcgctggcgcaatgggcggcacacggtgcagacggcctgaaaaacgccataaccggtcaaaccatcacttggatggatgcgtttatcggcaaactgcccggctccatcggcgaagtctccactttggcactcttaatcggcggcgcgtttatcgtgtttgcccgcatcgcttcttggcgcattattgccggcgtgatgatcggtatgattgccatgtcttcgctgttcaacttcatcggttcggacaccaacgctatgtttgctatgccttggtactggcatttggtcgtcggcggcttcgccatcggtatgctgtttatggcgaccgaccccgtttccgcttcctttaccaatgtcggcaaatggtggtacggcgcactgatcggtgtgatgtgcgtattaatccgcgtggtcaatccggcttaccccgaaggcatgatgttggcgattctgtttgccaacctgtttgccccgattttcgactatttcgtcgcacaagcgaacatcaaacgcagaaaggcgcgcagcaatggctaa

SEQ ID NO: 40865 - protein, 355 aa, Neisseria meningitidis
MMILVWLALFPAMFYGMYNVGAQAFGALTPDLLQQSIANDWHYALANALGINMSSEAGVLGKMLFGAIYFLPIYATVFIVGGFWEVLFATVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAITGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVVNPAYPEGMMLAILFANLFAPIFDYFVAQANIKRRKARSNG

SEQ ID NO: 40866 - DNA, 441 bp, Neisseria gonorrhoeae
atgacccggcgacgggtcggcaagcaaaaccgtattgccatccactccgcgcaataccgaaaaatggtcgtctttgcggtatttcagatacacgatgacggggattttcaactgcgcgagctgttcgaaagacagggcatagcctttcgcctcaaaacccaaatcgggcataatgcgccgcatatcctcaaacgacgcgcgcatctgttccttacccagtttttccaacacttcttcttccgtcagcttttgcccgtaaaaattgttcaaaagcgtcgccaccgaagccgccccgcaggaaaaatccaaatcctgctttacaatattgaaatcccgccgcgctttccaactctgcaatttgatttttccgtaaacaacaggattatcgttaaacatcggtgcagcattcaaacgataagacaagggtctgtaccagattag

SEQ ID NO: 40867 - protein, 146 aa, Neisseria gonorrhoeae
MTRRRVGKQNRIAIHSAQYRKMVVFAVFQIHDDGDFQLRELFERQGIAFRLKTQIGHNAPHILKRRAHLFLTQFFQHFFFRQLLPVKIVQKRRHRSRPAGKIQILLYNIEIPPRFPTLQFDFSVNNRIIVKHRCSIQTIRQGSVPD

SEQ ID NO: 40868 - DNA, 396 bp, Neisseria meningitidis
atgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcttcaaaacccaaatcaggcataatgcgccgcatatcctcaaacgacgcgggcatctgctccttatccagtttttttaacacgtcctcttccgtcagcttttgcccgtaaaaattgttcaaaagcgtcaccaccgaagccgccccgcaggaaaaatccaaatcctgctttacaatattgaaatcgcgcctttctttccaactctgcactttgatttttccataagcaacaggattatagtggattaa

SEQ ID NO: 40869 - protein, 130 aa, Neisseria meningitidis
MTQRRVGKQNRIAVYTAQYREMIILAVFQIHDDGDLQLCKLLERQGIAFRFKTQIRHNAPHILKRRGHLLLIQFFHVLFRQLLPVKIVQKRHHRSRPAGKIQILLYNIEIAPFFPTLHFDFSISNRIIVD

SEQ ID NO: 40870 - DNA, 396 bp, Neisseria meningitidis
atgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcctcaaaacccaaatcaggcatgatgcgccgcatatcctcaaacgacgcgcgcatctgctccttatccagctttttcaacacgtcctcttccgtcagcttttgcccgtgaaaattgttcaaaagcgtcgccaccgaagccgccccgcaggaaaaatccaaatcctgctttacaatattgaaatcgcgcctttctttccaactctgcactttgatttttccataagcaacaggattatagtggattaa

SEQ ID NO: 40871 - protein, 131 aa, Neisseria meningitidis
MTQRRVGKQNRIAVYTAQYREMIILAVFQIHDDGDLQLCKLLERQGIAFRLKTQIRHDAPHILKRRAHLLLIQLFQHVLFRQLLPVKIVQKRRHRSRPAGKIQILLYNIEIAPFFPTLHFDFSISNRIIVD

SEQ ID NO: 40872 - DNA, 996 bp, Neisseria gonorrhoeae
atgattggcggacagtttatcgtagttggcattgtaggcaaaaacgcacttgcccgctttgttgataatattgtcgtgaatatcggaatagttgacatagttgagcatgatgccctaatcgcggctgccgacggcgatattgtcgaacactttgagccgttcggaaaacatcagcacatagcccatattgttgcccacggaaatattgccgctgacttcgctgtcgttggtgtacatatagtggacggcgaaacgcaggtcgctgaagcggttgtttttataggtgttgtgcgtgctggtattggaaaaaatgccgtcccgccctttggaaatgtcgttgccgacgacctgcgcgccgggcgcgttccaaacggtaacgccattgccgcgctcattcacgcgcaaggtcgcatcgccgacgattttattctcgcgcaccatcgcatcggcagaaccatgaaggtatacgccgaacgaattatcaaaaatattgttgtgttcaaccagggcgcgcggggcggctttttcgagataaataccggcatccattgctggcaggctcataccggaacgggtaacggtcaggttgcggagcgttacgtccggcgcgtgtacggctatggtacgcccgctcttgtccccttcgatggttgcggaacggtcggcaggcccttcaatcgtaatcggtttgtcgatataaagtttggtttgatatacgccggaagccagtttgatcgtatcgcccgcccgggcgcgggcaaaaatttcggcaaggttgtcttgcggggaaacgtggacgacggctgccgatgccgtctgaaaaatgctgccggcggcaagtatcagcacggccttcagccatatacggagcgcggatgtgtgcatagtgtccctctgtttcgttcggtatggccgaacaaaataaagcatcattcaaatgtgcctgtttttatagcgaaaccgcctgaaacggtacggcaagcggtttggctataa

SEQ ID NO: 40873 - protein, 331 aa, Neisseria gonorrhoeae
MIGGQFIVVGIVGKNALARFVDNIVVNIGIVDIVEHDALIAAADGDIVEHFEPFGKHQHIAHIVAHGNIAADFAVVGVHIVDGETQVAEAVVFIGVVRAGIGKNAVPPFGNVVADDLRAGRVPNGNAIAALIHAQGRIADDFILAHHRIGRTMKVYAERIIKNIVVFNQGARGGFFEINTGIHCWQAHTGTGNGQVAERYVRRVYGYGTPALVPFDGCGTVGRPFNRNRFVDIKFGLIYAGSQFDRIARPGAGKNFGKVVLRGNVDDGCRCRLKNAAGGKYQHGLQPYTERGCVHSVPLFRSVWPNKIKHHSNVPVFIAKPPETVRQAVWL

SEQ ID NO: 40874 - DNA, 795 bp, Neisseria meningitidis
atgattggcgaaaagtttatcgtagttggcattataggcaaatacgcacttgcctgccttgttgataatgttgtcgtgaatatcggaatagttgacatagttgagcataatgccctgatcgcggctgccgacggcgatattgtcgaatactttgagccgctcggaaaacatcagcacatagcccatattgttgcccacggaaatattgccgctgatttcgctgtcgttggtgtacatatagtggacggcgaaacgcaaatcgctgaagcggttgtttttgtaggtgttgtgcgtgctggtattggaaaaaatgccgtcccgccctttggaaatgtcgttgccgacgacctgcgcaccgggtgcgttccaaacggtaacgccgttgccgcgctcgttcacgcgcaaagtcgcgtcgccgacgattttattctcgcgcaccatcgcatcggcagaaccatgcagatatacgccgaccgaattatccaaaatattgttgtgttcaatcagggcgcgcggggcagtttcttcgagataaataccggcatccattgcgggcaggctcataccggaacgggtaacggtcaggttgcggagcgttacgtccggcgcgtgtacggctatggtacgcccgctcctgtcgccttcgatggttgcggaacggtcggcaggcccttcaatcgtaatcggtttgtcaatgtgaagtttggttttatatacgccggaagccagtttgagcgtatcgcccgcccgggcgcgggcaaatgcgggataccgatcagcataatcggttcgtga

SEQ ID NO: 40875 - protein, 264 aa, Neisseria meningitidis
MIGEKFIVVGIIGKYALACLVDNVVVNIGIVDIVEHNALIAAADGDIVEYFEPLGKHQHIAHIVAHGNIAADFAVVGVHIVDGETQIAEAVVFVGVVRAGIGKNAVPPFGNVVADDLRTGCVPNGNAVAALVHAQSRVADDFILAHHRIGRTMQIYADRIIQNIVVFNQGARGSFFEINTGIHCGQAHTGTGNGQVAERYVRRVYGYGTPAPVAFDGCGTVGRPFNRNRFVNVKFGFIYAGSQFERIARPGAGKCGIPISIIGS

SEQ ID NO: 40876 - DNA, 798 bp, Neisseria meningitidis
atgattggcggacagtttatcgtagttggcattgtaggcaaaaacgcacttgcccgctttgttgataatgttgtcgtgaatatcggaatagttgacatagttgagcatgatgccttggtcgcggctgccgacggcgatattgtcaaacactttgagccgctcggaaaacatcagcacatagcccatattgttgcccacggaaatattgccgctgatttcgctgtcgttggtgtacatatagtggacggcgaaacgcaaatcgctgaagcggttgtttttataggtgttgtgcgtgctggtattggaaaaaatgccgtcccgccctttggaaatatcgttgccgacgacctgcgcgccgggcgcgttccaaacggtaacgccattgccgcgctcgttcacgcgcaaagtcgcgtcgccgacgattttattctcccgcaccatcgcatcggcagaaccatgcagatagacgccgaccgaattatccaaaatattattgtgttcaatcagggcgcgcggggcagtttcttcgagataaataccggcatccattgcgggcaggctcataccggaacgggtaacggtcaggttgcggagcgttacgtccggcgcgtgtacggctatggtacgcccgctcctgtctccttcgatggttgcagaacggtcggcaggcccttcaatcgtaatcggtttgtcgatgtgaagtttggtttgatatacgccggaagccagtttgagcgtatcgcccgcccgggcgcgggcaaatgcgggataccgatcagcataatcgactcatggtga

SEQ ID NO: 40877 - protein, 265 aa, Neisseria meningitidis
MIGGQFIVVGIVGKNALARFVDNVVVNIGIVDIVEHDALVAAADGDIVKHFEPLGKHQHIAHIVAHGNIAADFAVVGVHIVDGETQIAEAVVFIGVVRAGIGKNAVPPFGNIVADDLRAGRVPNGNAIAALVHAQSRVADDFILPHHRIGRTMQIDADRIIQNIIVFNQGARGSFFEINTGIHCGQAHTGTGNGQVAERYVRRVYGYGTPAPVSFDGCRTVGRPFNRNRFVDVKFGLIYAGSQFERIARPGAGKCGIPISIIDSW

SEQ ID NO: 40878 - DNA, 1035 bp, Neisseria gonorrhoeae
atgagcctgccagcaatggatgccggtatttatctcgaaaaagccgccccgcgcgccctggttgaacacaacaatatttttgataattcgttcggcgtataccttcatggttctgccgatgcgatggtgcgcgagaataaaatcgtcggcgatgcgaccttgcgcgtgaatgagcgcggcaatggcgttaccgtttggaacgcgcccggcgcgcaggtcgtcggcaacgacatttccaaagggcgggacggcattttttccaataccagcacgcacaacacctataaaaacaaccgcttcagcgacctgcgtttcgccgtccactatatgtacaccaacgacagcgaagtcagcggcaatatttccgtgggcaacaatatgggctatgtgctgatgttttccgaacggctcaaagtgttcgacaatatcgccgtcggcagccgcgattagggcatcatgctcaactatgtcaactattccgatattcacgacaatattatcaacaaagcgggcaagtgcgtttttgcctacaatgccaactacgataaactgtccgccaatcattttgaaaactgccaaatcggcatgcactttaccgccgccatcgaaggcacgtccctgcacgacaattcctttatcaacaacggaagccaggtcaaatatgtcagtacgcgctttctcgactggagcgagggcggacacggcaactactggagcgacaacagcccgttcgatttgaacggcgacggcttcggagacagcgcgtaccgtcccgacggcatcatcgaccaaatcatctggcgcgcgcccgtatcgcgcctcttgatgaacagtcccgcaatcagcatcgtcaaatgggcgcaggcgcagtttcccgccgttctgcccggcggcgtggtggacagcaaaccgctgatgaagccttatgcccccaaaattcaaacccgttatcaggcgatgaaggacgagttgctcaaagaagccgaaacgcggcagtcggaacggggcagggcggaaaacggttctttgaactag

SEQ ID NO: 40879 - protein, 343 aa, Neisseria gonorrhoeae
MSLPAMDAGIYLEKAAPRALVEHNNIFDNSFGVYLHGSADAMVRENKIVGDATLRVNERGNGVTVWNAPGAQVVGNDISKGRDGIFSNTSTHNTYKNNRFSDLRFAVHYMYTNDSEVSGNISVGNNMGYVLMFSERLKVFDNIAVGSRDGIMLNYVNYSDIHDNIINKAGKCVFAYNANYDKLSANHFENCQIGMHFTAAIEGTSLHDNSFINNGSQVKYVSTRFLDWSEGGHGNYWSDNSPFDLNGDGFGDSAYRPDGIIDQIIWRAPVSRLLMNSPAISIVKWAQAQFPAVLPGGVVDSKPLMKPYAPKIQTRYQAMKDELLKEAETRQSERGRAENGSLN

SEQ ID NO: 40880 - DNA, 1035 bp, Neisseria meningitidis
atgagcctgcccgcaatggatgccggtatttatctcgaagaaactgccccgcgcgccctgattgaacacaacaatattttggataattcggtcggcgtatatctgcatggttctgccgatgcgatggtgcgcgagaataaaatcgtcggcgacgcgactttgcgcgtgaacgagcgcggcaacggcgttaccgtttggaacgcacccggtgcgcaggtcgtcggcaacgacatttccaaagggcgggacggcattttttccaataccagcacgcacaacacctacaaaaacaaccgcttcagcgatttgcgtttcgccgtccactatatgtacaccaacgacagcgaaatcagcggcaatatttccgtgggcaacaatatgggctatgtgctgatgttttccgagcggctcaaagtattcgacaatatcgccgtcggcagccgcgatcagggcattatgctcaactatgtcaactattccgatattcacgacaacattatcaacaaggcaggcaagtgcgtatttgcctataatgccaactacgataaacttttcgccaatcattttgaaaactgtcaaatcggcatacactttaccgccgccatcgaaggcacgtccttgcatgacaattcctttatcaacaacgaaagccaggtcaaatacgtcagcacgcgctttctcgattggagcgagggcggacacggcaactattggagcgacaacagcgcgttcgatttgaacggcgacggcttcggagacagcgcgtaccgccccaacggcatcatcgaccaaatcatctggcgcgcgcccgtatcgcgccttttgatgaacagtcccgcaatcagcatcgtcaaatgggcgcaggcgcagtttcccgccgttctgcctggcggcgtggtggacagcaaaccgctgatgaagccttatgcccccaaaattcaaacccgttatcaggcgatgaaggacgagctactcaaagaagtcgaaacgcggcagtcggaatggggcagggcggaaaacggttctttgaactag

SEQ ID NO: 40881 - protein, 344 aa, Neisseria meningitidis
MSLPAMDAGIYLEETAPRALIEHNNILDNSVGVYLHGSADAMVRENKIVGDATLRVNERGNGVTVWNAPGAQVVGNDISKGRDGIFSNTSTHNTYKNNRFSDLRFAVHYMYTNDSEISGNISVGNNMGYVLMFSERLKVFDNIAVGSRDQGIMLNYVNYSDIHDNIINKAGKCVFAYNANYDKLFANHFENCQIGIHFTAAIEGTSLHDNSFINNESQVKYVSTRFLDWSEGGHGNYWSDNSAFDLNGDGFGDSAYRPNGIIDQIIWRAPVSRLLMNSPAISIVKWAQAQFPAVLPGGVVDSKPLMKPYAPKIQTRYQAMKDELLKEVETRQSEWGRAENGSLN

SEQ ID NO: 40882 - DNA, 1035 bp, Neisseria meningitidis
atgagcctgcccgcaatggatgccggtatttatctcgaagaaactgccccgcgcgccctgattgaacacaataatattttggataattcggtcggcgtctatctgcatggttctgccgatgcgatggtgcgggagaataaaatcgtcggcgacgcgactttgcgcgtgaacgagcgcggcaatggcgttaccgtttggaacgcgcccggcgcgcaggtcgtcggcaacgatatttccaaagggcgggacggcattttttccaataccagcacgcacaacacctataaaaacaaccgcttcagcgatttgcgtttcgccgtccactatatgtacaccaacgacagcgaaatcagcggcaatatttccgtgggcaacaatatgggctatgtgctgatgttttccgagcggctcaaagtgtttgacaatatcgccgtcggcagccgcgaccaaggcatcatgctcaactatgtcaactattccgatattcacgacaacattatcaacaaagcgggcaagtgcgtttttgcctacaatgccaactacgataaactgtccgccaatcattttgaaaactgccaaatcggcatacactttaccgccgccatcgaaggcacgtccctgcacgacaattcctttatcaacaacgaaagccaggtcaaatacgtcagcacgcgctttctcgactggagcgagggcggacacggcaactattggagcgacaacagcgcgttcgatttgaacggcgacggcttcggagacagcgcgtaccgtcccaacggcatcatcgaccaaatcatctggcgcgcacccgtatcgcgcctcttgatgaacagtcccgcaatcagcatcgtcaaatgggcgcaggcgcaatttcccgccgttttgcctggcggcgtggtggacagcaaaccgctgatgaagccttatgcccccaaaattcaaacccgttatcaggcgatgaaggacgggctgctcaaaaaagtcgaaacgcggcagttggaatggggcagggcggaaaacggttctttgaactag

SEQ ID NO: 40883 - protein, 344 aa, Neisseria meningitidis
MSLPAMDAGIYLEETAPRALIEHNNILDNSVGVYLHGSADAMVRENKIVGDATLRVNERGNGVTVWNAPGAQVVGNDISKGRDGIFSNTSTHNTYKNNRFSDLRFAVHYMYTNDSEISGNISVGNNMGYVLMFSERLKVFDNIAVGSRDQGIMLNYVNYSDIHDNIINKAGKCVFAYNANYDKLSANHFENCQIGIHFTAAIEGTSLHDNSFINNESQVKYVSTRFLDWSEGGHGNYWSDNSAFDLNGDGFGDSAYRPNGIIDQIIWRAPVSRLLMNSPAISIVKWAQAQFPAVLPGGVVDSKPLMKPYAPKIQTRYQAMKDGLLKKVETRQLEWGRAENGSLN

SEQ ID NO: 40884 - DNA, 1191 bp, Neisseria gonorrhoeae
atgattcatataatatcaatattaaagagtatcggtatatcggggatagctatgtcctgtttttcaatccggcgtatgtctgcgtttcgggcgcggataacggcgttttttaccgcctttgtctttttgacggcggcactgcccgcttatgcggagcgtctgcctgattttctggcgaaaatacagccttcggaaatttttccgggtgcggatcgttacggcaagccggaaggcaagcctatggttgcccgcgtttacaaaggcgatgagcagctcggtttggtttatatcacgaccgatgcggtcaatacgcgcggttattcgagcaaaccgatcgatacgctgatggctttggcaaacgacggcacgatagccggggcgaaactggtcgatcatcacgaaccgattatgctgatcggtatcccgcaatcgcgtgtcgataagttcatcgacaaatatatcggtctgaattttattaaaaatccgccgaccccgagcgtggcgccgggcgacatcatcagcggtgcgactgttacactgatggtggttaacgacagcatccagcgttcgtacaaggtcattgccaaccaataccgtctgggttcggacaaggcccttcagacggcatccgcttccgatgttcgggaagccgcgcctgcgtcagaaacccgtccgcgccgtatggcaaatcccgacaagcaggatattttgtcttgggacgaacttttgaaacaaaaggccgtcggccatctgcatatcacgctcgatcaaatcaacaaactgtttgagaaaggcggcaaggccggcgtggccgatcacgccgaacagggcgatcctgacgatacctttattgatttgtatgttgccttggtcagccagccttccatcggtaaaagcctgctgggtgaggacggctgggcgcatctgcaaaaacggctgaaacccgggcagcaggcggttttggttgccggagagggccgttattcttggaaaggttcgggctatgtgcgcggcggtattttcgaccgtatcgagatgattcagggggagaacagcttccgttttaccgatgcccaacacgaacgcgtcgtcgagctgtctgccgccgatgcgccgcgttttaaagaagtttcttggtttaccatccctgaaggcgtagcgtttgacggtgcggagccgtggcggctgtaa

SEQ ID NO: 40885 - protein, 396 aa, Neisseria gonorrhoeae
MIHIISILKSIGISGIAMSCFSIRRMSAFRARITAFFTAFVFLTAALPAYAERLPDFLAKIQPSEIFPGADRYGKPEGKPMVARVYKGDEQLGLVYITTDAVNTRGYSSKPIDTLMALANDGTIAGAKLVDHHEPIMLIGIPQSRVDKFIDKYIGLNFIKNPPTPSVAPGDIISGATVTLMVVNDSIQRSYKVIANQYRLGSDKALQTASASDVREAAPASETRPRRMANPDKQDILSWDELLKQKAVGHLHITLDQINKLFEKGGKAGVADHAEQGDPDDTFIDLYVALVSQPSIGKSLLGEDGWAHLQKRLKPGQQAVLVAGEGRYSWKGSGYVRGGIFDRIEMIQGENSFRFTDAQHERVVELSAADAPRFKEVSWFTIPEGVAFDGAEPWRL

SEQ ID NO: 40886 - DNA, 429 bp, Neisseria meningitidis
atgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaatttttccgggtgcggaccgttacggcaagccggaaggtaagcctatggttgcccgcgtttacaaaggcgatgagcagttgggcttggtctatatcacgaccgatgcggtcaatacgcgcggttattcgagcaaaccgattgatacgctgatggtgttggcaaacgacggcacgatagccggggcgaaactggtcgaccatcacgaaccgattatgctgatcggtatcccgcat

SEQ ID NO: 40887 - protein, 143 aa, Neisseria meningitidis
MIHIISILKSIGISGIVMSCFSIKRMSAFRARITAFFAAFVFLTAALPAYAERLPDFLAKIQPSEIFPGADRYGKPEGKPMVARVYKGDEQLGLVYITTDAVNTRGYSSKPIDTLMVLANDGTIAGAKLVDHHEPIMLIGIPH

SEQ ID NO: 40888 - DNA, 429 bp, Neisseria meningitidis
atgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaattgttccgggtgcggaccgttacagcaagccggaaggtaagcctatggttgcccgcgtttacaaaggcgatgagcagttgggcttggtctatatcacgaccgatgcggtcaatacgcgcggttattcgagcaaaccgattgatacgctgatggcgttggctaaagacggtacgatagccggagcgaaattggttgatcaccatgagtcgattatgctgatcggtatcccgcat

SEQ ID NO: 40889 - protein, 143 aa, Neisseria meningitidis
MIHIISILKSIGISGIVMSCFSIKRMSAFRARITAFFAAFVFLTAALPAYAERLPDFLAKIQPSEIVPGADRYSKPEGKPMVARVYKGDEQLGLVYITTDAVNTRGYSSKPIDTLMALAKDGTIAGAKLVDHHESIMLIGIPH

SEQ ID NO: 40890 - DNA, 1293 bp, Neisseria gonorrhoeae
atgcggtatccgccgcaatcggcggttttgcagaatgccgcgcgttgccttttgcgccgcccgaaatctgcctgccgccgtatttgcccgctatccgcaatatcggcagtccaatatatctttgcggatgtcgttcagcaggaaggctgtggtgtcttcgtgttcctcctgtacgaagacaaaaagtcgggcgatgattttgccgatgaagactttttgcagggcgcaggcgtcggtcagggtgtgttcctgcaggaagctgcggatgtcttcgggcaaagcgtagtcgcgggcaacggcggcaaagcggacatcggtttgcacggcgtcgagcagggtttggtttttgtccaacttaatgcctgcttctttttcttcggcggtggcgcggacgaactggtcgtaaatttcggcataaagcatatcgttcgggccttcaaaaatcgtgaaggggcggatatcgatggcgatattgccggctgggtgtccgcgttcaaaacccttcgcgcccaagagtttttgcaacatttgcgcggcggcgtaagtgtattccgtggcgagggttttgacgatgttcgcctccatcaattgatgggcgacgggcgcgacgggcgaaacggaatggcagacgtagcggtaaaggatttcggaaacctgatggcggcgttggatttcgcggcgttcgtaatcgacgaatctgatatcgttgcggacatatcggttcaggttgtcaaggatgtattccataatgccgtgcgtcatgccgatcagttgcaggcggctgcggataaagatgttttggaacgcgcgcaaaccggcagcgtcgccccgggagagtttcatcacggcggttgcaggcatttcggcatcgatgcggttgacggcgtaacggacggcgcgcaggccttcggatgcgagggtttcgcagcggatgtatgttttggggacgagcagcaggtcgatgactttggcgagtttgccgtttttgcgctctttggcggcaacgaggaggaagtcgctttgcgaattgccctgccagtatttcgcggcgttgacgtaaatggtttgttcgtcggtatattcgtagcaggactgcatttcgcgtgcaatcgccgcgccggaggtttcgggttcggtaacgcccaaacggcggctttcgcctttgaaaatcatgtccaaaccttgtgcgacttgcgcttcgccgccgaactcttgcagaggctgcaacaccagcgcgccttcgatgccggtacgcagcgtaacgggcacgccgtaatgccccgcaatccttag

SEQ ID NO: 40891 - protein, 430 aa, Neisseria gonorrhoeae
MRYPPQSAVLQNAARCLLRRPKSACRRICPLSAISAVQYIFADVVQQEGCGVFVFLLYEDKKSGDDFADEDFLQGAGVGQGVFLQEAADVFGQSVVAGNGGKADIGLHGVEQGLVFVQLNACFFFFGGGADELVVNFGIKHIVRAFKNREGADIDGDIAGWVSAFKTLRAQEFLQHLRGGVSVFRGEGFDDVRLHQLMGDGRDGRNGMADVAVKDFGNLMAALDFAAFVIDESDIVADISVQVVKDVFHNAVRHADQLQAAADKDVLERAQTGSVAPGEFHHGGCRHFGIDAVDGVTDGAQAFGCEGFAADVCFGDEQQVDDFGEFAVFALFGGNEEEVALRIALPVFRGVDVNGLFVGIFVAGLHFACNRRAGGFGFGNAQTAAFAFENHVQTLCDLRFAAELLQRLQHQRAFDAGTQRNGHAVMPRNP

SEQ ID NO: 40892 - DNA, 1221 bp, Neisseria meningitidis
gcctgccgccgtatttgcccgctacccgcaatatcggcagtccaatatatctttgcggatgtcgttcagcaggaaggctgcggtgtcttcgtgtttcgcctgtacgaagacaaagagtcgggcgatgattttgccgataaagactttttgcagggcgcaggcatcggtcagggtgtgttcctgcaggaagctgcggatgtcttcaggcaaagtgtagtcgcgggcgacggcggcaaagcgggcatcggtttgcaggcggtcgagcagggtttggtttttgtccaacttcatgcctgcttctttttcttcggcggtggcgcggacaaactggtcgtaaatttcggcataaagcatatcgttcgggccttcaaaaatcgtgaaggggcggatgtcgatagcgatattgccggcggtgtgtccgcgttcaaaacccttcgcacccaagagtttttgcaacatttgcgcggcggcgtaagtgtattccgtggcgagggttttgacgatgttcgcctccatcagctgatgggcgacgggggcaacaggcgaaacggaatggcagacgtagcggtaaagaatctcggaaacctgatggcggcgccggatttcgcggcgttcgtaatcgacgaatttgatgtcgttgcggacgtatcgttccagattttcaaggatgtattccataatgccgtgcgtcatgccgatcagttgcaggcggctgcggataaagatgttttggaacgcgcgcaaaccggcagcgtcgctctgggagagtttcatcacggcggttgcaggcatttcggcatcgatgcggttgacggcgtaacggacggcgcgcaagccttcggatgcgagggtttcgcagcggatgtatgttttggggacgagcagcaggtcgatgactttggcgagtttgccgtttttgcgctctttggcggcaacgaggaggaagtcgctttgcgagttgccctgccagtatttcgcggcgttgacgtaaatggtttgtccgtcgatatattcgtagtaggactgcatttcgcgtgcaatcgccgcgccggaggtttcgggttcggtaacacccaaaccgccgccctcgcctttgaaaatcatctccaaaccttgcgcgacttgcgcttcatcgccgaactcttgcagtggctgcaacaccagcgcgccttcgatgccggtacgcagcgtaacgggcacgccgtaatgccccgcaatccg

SEQ ID NO: 40893 - protein, 407 aa, Neisseria meningitidis
ACRRICPLPAISAVQYIFADVVQQEGCGVFVFRLYEDKESGDDFADKDFLQGAGIGQGVFLQEAADVFRQSVVAGDGGKAGIGLQAVEQGLVFVQLHACFFFFGGGADKLVVNFGIKHIVRAFKNREGADVDSDIAGGVSAFKTLRTQEFLQHLRGGVSVFRGEGFDDVRLHQLMGDGGNRRNGMADVAVKNLGNLMAAPDFAAFVIDEFDVVADVSFQIFKDVFHNAVRHADQLQAAADKDVLERAQTGSVALGEFHHGGCRHFGIDAVDGVTDGAQAFGCEGFAADVCFGDEQQVDDFGEFAVFALFGGNEEEVALRVALPVFRGVDVNGLSVDIFVVGLHFACNRRAGGFGFGNTQTAALAFENHLQTLRDLRFIAELLQWLQHQRAFDAGTQRNGHAVMPRNP

SEQ ID NO: 40894 - DNA, 1221 bp, Neisseria meningitidis
gcctgccgccgtatttgcccgctatccgcaatatcggcagtccaatatgtctttgcggatgtcgttcagcaggaaggctgcggtgtcttcgtgttccgcctgtacgaagacaaagagtcgggcgatgattttgccgataaagactttttgcagggcgcaggcatcggtcagggtgtgttcctgcaggaagctgcggatgtcttcgggcaaagtgtagtcgcgggcgacggcggcaaagcgggcatcggtttgcaggcggtcgagcagggtttggtttttgtccaacttcatgcctgcttctttttcttcggcggtggcgcggacaaactggtcgtaaatttcggcataaagcatatcgttcgggccttcaaaaatcgtgaaggggcggatgtcgatagcgatattgccggcggtgtgtccgcgttcaaaacccttcgcgcccaagagtttttgcaacatttgcgcggcggcgtaagtgtattccgtggcgagggttttgacgatgttcgcctccatcagttgatgggcgacgggtgcaacgggcgaaacggaatggcagacgtagcggtaaagaatctcggaaacctgatggcggcgccggatttcgcggcgttcgtaatcgacgaatctgatgtcgttgcggacgtatcgttccaggttttcaagggtgtattccataatgccgtgcgtcatgccgatcagttgcaggcggctgcggataaagatgttttggaacgcgcgcaaaccggcagcgtcgctctgggagagtttcatcacggcggttgcaggcatttcggcatcgatgcggttgacggcgtaacggacggcgcgcaagccttcggatgcgagggtttcgcagcggatgtatgttttggggacgagcagcaggtcgatgactttggcgagtttgccgtttttgcgctctttggcggcaacgaggaggaagtcgctttgcgagttgccctgccagtatttcgcggcgttgacgtaaatggtttgtccgtcggtatattcgtagtaagactgcatttctcgggcaatcgccgcgccggaggtttcgggttcggtaacgcctaaaccgccgccctcgcctttgaaaaccatgtccaaaccctgtgcgatttgcgcttcatcgccgaactcttgcagtggctgcaacaccagcgcgccttcgatgccggtacgcagcgtaacgggcacgccgtaatgccccgcaatccg

SEQ ID NO: 40895 - protein, 406 aa, Neisseria meningitidis
ACRRICPLSAISAVQYVFADVVQQEGCGVFVFRLYEDKESGDDFADKDFLQGAGIGQGVFLQEAADVFGQSVVAGDGGKAGIGLQAVEQGLVFVQLHACFFFFGGGADKLVVNFGIKHIVRAFKNREGADVDSDIAGGVSAFKTLRAQEFLQHLRGGVSVFRGEGFDDVRLHQLMGDGCNGRNGMADVAVKNLGNLMAAPDFAAFVIDESDVVADVSFQVFKGVFHNAVRHADQLQAAADKDVLERAQTGSVALGEFHHGGCRHFGIDAVDGVTDGAQAFGCEGFAADVCFGDEQQVDDFGEFAVFALFGGNEEEVALRVALPVFRGVDVNGLSVGIFVVRLHFSGNRRAGGFGFGNATAALAFENHVQTLCDLRFIAELLQWLQHQRAFDAGTQRNGHAVMPRNP

SEQ ID NO: 40896 - DNA, 411 bp, Neisseria gonorrhoeae
  misc_feature (57)..(57): n is a, c, g, or t
atggtgttgcctttgatgttgttggcgacaatcaggtcggctacgctgacgttgtancgtttggcaatgttgaacagggtgtcgccttctacaacgcggtggatgctggcatggagcggggaggtttcggcttcgccgtcggcagctttggctacgcgcgtttccaaacgtgcccggcgtttgccgtcggcggcaacggtatgttgcggagatgaggaaatgttgtgttcggcaactgtgtcaggcgtgccgatgacggcggagatggtttcttcagcctgccggcgcaggttgtttcgggcaacaagctgcatgagttcgtctgccgcctgcatgtcgtttggggggatgacctgcgcgagtgttgcggtttgggtttcagacggcatggcagtctgtttttcggtttga

SEQ ID NO: 40897 - protein, 136 aa, Neisseria gonorrhoeae
  misc_feature (19)..(19): Xaa can be any naturally occurring amino acid
MVLPLMLLATIRSATLTLXRLAMLNRVSPSTTRWMLAWSGEVSASPSAALATRVSKRARRLPSAATVCCGDEEMLCSATVSGVPMTAEMVSSACRRRLFRATSCMSSSAACMSFGGMTCASVAVWVSDGMAVCFSV

SEQ ID NO: 40898 - DNA, 411 bp, Neisseria meningitidis
atggtgttgcctttgatgttgttggcgacaatcaggtcggctacactgacgttgtagcgtttggcaatgttgaacagggtgtcgccttctacaacgcggtggatgctggcatggagcggggagatttcggcttcgccgtcggcagctttggctacgcgcgtttccaaacgtacccggcgtttgccgtcggcggcagcggtatgttgcggagatgcggaaattttgtgttcggcaactgtgtcaggcgtgccgatgacggcggagatggtttcttcagcctgtcggcgcaggttgtttcgggcaacaagctgcatgagttcgtctgccgcctgcatgtcgttttgggggatgatctgcgcgagtgttgcggtttgggtttcagacggcatggcggtctgtttttcggtttga

SEQ ID NO: 40899 - protein, 135 aa, Neisseria meningitidis
MVLPLMLLATIRSATLTLRLAMLNRVSPSTTRWMLAWSGEISASPSAALATRVSKRTRRLPSAAAVCCGDAEILCSATVSGVPMTAEMVSSACRRRLFRATSCMSSSAACMSFWGMICASVAVWVSDGMAVCFSV

SEQ ID NO: 40900 - DNA, 411 bp, Neisseria meningitidis
atggtgttgcctttgatgttgttggcgacaatcaggtcggctacactgacgttgtagcgtttggcaatgttgaacagggtgtcgccttctacaacgcggtggatgctggcatggagcggggagatttcggcttcgccgtcggcagctttggctacgcgcgtttccaaacgtacccggcgtttgccgtcggcggcaacggtatgttgcggagatgaggaaatgttgtgttcggcaactgtgtcaggcgtgccgatgacggcagagatggtttcttcagcctgtcggcgcaggttgtttcgggcaacaagctgcatgagttcgtctgccgcctgcatgtcgttttgggggacgatctgcgcgagtgttgcggtttgggtttcagacggcatggcggtctgtttttcggtttga

SEQ ID NO: 40901 - protein, 135 aa, Neisseria meningitidis
MVLPLMLLATIRSATLTLRLAMLNRVSPSTTRWMLAWSGEISASPSAALATRVSKRTRRLPSAATVCCGDEEMLCSATVSGVPMTAEMVSSACRRRLFRATSCMSSSAACMSFWGTICASVAVWVSDGMAVCFSV

SEQ ID NO: 40902 - DNA, 1554 bp, Neisseria meningitidis
atgccgtctgaaaggccggcggattgttgcccggtgcactttgtggtaaagtttagaaaattaactctaaactgtggcaggcggtttgaccggccgccgattaatgggaaccgacagaggaagccgatgatacacaccgaaccgagcgcgcagccgtcaaccatggacacggctgcttttttaaagcacatcgaatccgcattcccccgcattttttcagacggcatcgacctgatgcgatacctgcccgaagacaaatggcttgccttgaagcaggcgggtttgctgttgcccttcctcgacaaaaaacacggcgggcgcaagggcagtcagtttgaaatccaagaagtcctaaggattgcggggcattacggcgtgcccgttacgctgcgtaccggcatcgaaggcgcgctggtgttgcagcctctgcaagagttcggcggcgaagcgcaagtcgcacaaggtttggacatgattttcaaaggcgaaagccgccgtttgggcgttaccgaacccgaaacctccggcgcggcgattgcacgcgaaatgcagtcctgctacgaatataccgacgaacaaaccatttacgtcaacgccgcgaaatactggcagggcaattcgcaaagcgacttcctcctcgttgccgccaaagagcgcaaaaacggcaaactcgccaaagtcatcgacctgctgctcgtccccaaaacatacatccgctgcgaaaccctcgcatccgaaggcctgcgcgccgtccgttacgccgtcaaccgcatcgatgccgaaatgcctgcaaccgccgtgatgaaactctcccggggcgacgctgccggtttgcgcgcgttccaaaacatctttatccgcagccgcctgcaactgatcggcatgacgcacggcattatggaatacatccttgacaacctgaaccgatatgtccgcaacgatatcagattcgtcgattacgaacgccgcgaaatccaacgccgccatcaggtttccgaaatcctttaccgctacgtctgccattccgtttcgcccgtcgcgcccgtcgcccatcaattgatggaggcgaacatcgtcaaaaccctcgccacggaatacacttacgccgccgcgcaaatgttgcaaaaactcttgggcgcgaagggttttgaacgcggacacccagccggcaatatcgccatcgatatccgccccttcacgatttttgaaggcccgaacgatatgctttatgccgaaatttacgaccagttcgtccgcgccaccgccgaagaaaaagaagcaggcattaagttggacaaaaaccaaaccctgctcgacgccgtgcaaaccgatgtccgctttgccgccgttgcccgcgactacgctttgcccgaagacatccgcagcttcctgcaggaacacaccctgaccgacgcctgcgccctgcaaaaagtcttcatcggcaaaatcatcgcccgactttttgtcttcgtacaggaggaacacgaagacaccacagccttcctgctgaacgacatccgcaaagatatattggactgccgatattgcggatag

SEQ ID NO: 40903 - protein, 517 aa, Neisseria meningitidis
MPSERPADCCPVHFVVKFRKLTLNCGRRFDRPPINGNRQRKPMIHTEPSAQPSTMDTAAFLKHIESAFPRIFSDGIDLMRYLPEDKWLALKQAGLLLPFLDKKHGGRKGSQFEIQEVLRIAGHYGVPVTLRTGIEGALVLQPLQEFGGEAQVAQGLDMIFKGESRRLGVTEPETSGAAIAREMQSCYEYTDEQTIYVNAAKYWQGNSQSDFLLVAAKERKNGKLAKVIDLLLVPKTYIRCETLASEGLRAVRYAVNRIDAEMPATAVMKLSRGDAAGLRAFQNIFIRSRLQLIGMTHGIMEYILDNLNRYVRNDIRFVDYERREIQRRHQVSEILYRYVCHSVSPVAPVAHQLMEANIVKTLATEYTYAAAQMLQKLLGAKGFERGHPAGNIAIDIRPFTIFEGPNDMLYAEIYDQFVRATAEEKEAGIKLDKNQTLLDAVQTDVRFAAVARDYALPEDIRSFLQEHTLTDACALQKVFIGKIIARLFVFVQEEHEDTTAFLLNDIRKDILDCRYCG

SEQ ID NO: 40904 - DNA, 1554 bp, Neisseria meningitidis
atgccgtctgaaaggtcggcggattgttgcccggcgcactttgtggtaaagtttagaaaatcaactctaaactgtggcaggcggtttgaccggccgccgattaatgggaaccgacagaggaagccgatgatacacaccgaaccgagcgcgcagccgtcaactatggacacggctgcttttttaaagcacatcgaatccgcattccgccgcattttttcagacggtatcgacctgatgcgatacctgcccgaagacaaatggcttgccttgaagcaggcgggtttgctgttgcccttcctcgacaaaaaatacggcgggcgcaagggcagccagtttgaaatccaagaagtcctgcggattgcggggcattacggcgtgcccgttacgctgcgtaccggcatcgaaggcgcgctggtgttgcagccactgcaagagttcggcgatgaagcgcaagtcgcgcaaggtttggagatgattttcaaaggcgagggcggcggtttgggtgttaccgaacccgaaacctccggcgcggcgattgcacgcgaaatgcagtcctactacgaatatatcgacggacaaaccatttacgtcaacgccgcgaaatactggcagggcaactcgcaaagcgacttcctcctcgttgccgccaaagagcgcaaaaacggcaaactcgccaaagtcatcgacctgctgctcgtccccaaaacatacatccgctgcgaaaccctcgcatccgaaggcttgcgcgccgtccgttacgccgtcaaccgcatcgatgccgaaatgcctgcaaccgccgtgatgaaactctcccagagcgacgctgccggtttgcgcgcgttccaaaacatctttatccgcagccgcctgcaactgatcggcatgacgcacggcattatggaatacatccttgaaaatctggaacgatacgtccgcaacgacatcaaattcgtcgattacgaacgccgcgaaatccggcgccgccatcaggtttccgagattctttaccgctacgtctgccattccgtttcgcctgttgcccccgtcgcccatcagctgatggaggcgaacatcgtcaaaaccctcgccacggaatacacttacgccgccgcgcaaatgttgcaaaaactcttgggtgcgaagggttttgaacgcggacacaccgccggcaatatcgctatcgacatccgccccttcacgatttttgaaggcccgaacgatatgctttatgccgaaatttacgaccagtttgtccgcgccaccgccgaagaaaaagaagcaggcatgaagttggacaaaaaccaaaccctgctcgaccgcctgcaaaccgatgcccgctttgccgccgtcgcccgcgactacactttgcctgaagacatccgcagcttcctgcaggaacacaccctgaccgatgcctgcgccctgcaaaaagtctttatcggcaaaatcatcgcccgactctttgtcttcgtacaggcgaaacacgaagacaccgcagccttcctgctgaacgacatccgcaaagatatattggactgccgatattgcgggtag

SEQ ID NO: 40905 - protein, 517 aa, Neisseria meningitidis
MPSERSADCCPAHFVVKFRKSTLNCGRRFDRPPINGNRQRKPMIHTEPSAQPSTMDTAAFLKHIESAFRRIFSDGIDLMRYLPEDKWLALKQAGLLLPFLDKKYGGRKGSQFEIQEVLRIAGHYGVPVTLRTGIEGALVLQPLQEFGDEAQVAQGLEMIFKGEGGGLGVTEPETSGAAIAREMQSYYEYIDGQTIYVNAAKYWQGNSQSDFLLVAAKERKNGKLAKVIDLLLVPKTYIRCETLASEGLRAVRYAVNRIDAEMPATAVMKLSQSDAAGLRAFQNIFIRSRLQLIGMTHGIMEYILENLERYVRNDIKFVDYERREIRRRHQVSEILYRYVCHSVSPVAPVAHQLMEANIVKTLATEYTYAAAQMLQKLLGAKGFERGHTAGNIAIDIRPFTIFEGPNDMLYAEIYDQFVRATAEEKEAGMKLDKNQTLLDRLQTDARFAAVARDYTLPEDIRSFLQEHTLTDACALQKVFIGKIIARLFVFVQAKHEDTAAFLLNDIRKDILDCRYCG

SEQ ID NO: 40906 - DNA, 1554 bp, Neisseria meningitidis
  misc_feature (386)..(402): n is a, c, g, or t
atgccgtctgaaaggtcggcggattgttgcccggcgcactttgtggtaaagtttagaaaatcaactctaaactgtggcaggcggtttgaccggccgccgattaatgggaaccgacagaggaagccgatgatacacaccgaaccgagcgcgcagccgtcaactatggacacggctgcttttttaaagcacatcgaatccgcattccgccgcatttttgcagacggtatcgacctgatgcgatacctgcccgaagacaaatggcttgccttgaagcaggcgggtttgctgttgcccttcctcgacaaaaaatacggcgggcgcaagggcagccagtttgaaattcaggaagtcttgcggattgcggggcattacggcgtgcccgttannnnnnnnnnnnnnnnngaaggcgcgctggtgttgcagccactgcaagagttcggcgatgaagcgcaaatcgcacagggtttggacatggttttcaaaggcgagggcggcggtttaggcgttaccgaacccgaaacctccggcgcggcgattgcccgagaaatgcagtcttactacgaatataccgacggacaaaccatttacgtcaacgccgcgaaatactggcagggcaactcgcaaagcgacttcctcctcgttgccgccaaagagcgcaaaaacggcaaactcgccaaagtcatcgacctgctgctcgtccccaaaacatacatccgctgcgaaaccctcgcatccgaaggcttgcgcgccgtccgttacgccgtcaaccgcatcgatgccgaaatgcctgcaaccgccgtgatgaaactctcccagagcgacgctgccggtttgcgcgcgttccaaaacatctttatccgcagccgcctgcaactgatcggcatgacgcacggcattatggaatacacccttgaaaacctggaacgatacgtccgcaacgacatcagattcgtcgattacgaacgccgcgaaatccggcgccgccatcaggtttccgagattctttaccgctacgtctgccattccgtttcgcccgttgcacccgtcgcccatcaactgatggaggcgaacatcgtcaaaaccctcgccacggaatacacttacgccgccgcgcaaatgttgcaaaaactcttgggcgcgaagggttttgaacgcggacacaccgccggcaatatcgctatcgacatccgccccttcacgatttttgaaggcccgaacgatatgctttatgccgaaatttacgaccagtttgtccgcgccaccgccgaagaaaaagaagcaggcatgaagttggacaaaaaccaaaccctgctcgaccgcctgcaaaccgatgcccgctttgccgccgtcgcccgcgactacactttgcccgaagacatccgcagcttcctgcaggaacacaccctgaccgatgcctgcgccctgcaaaaagtctttatcggcaaaatcatcgcccgactctttgtcttcgtacaggcggaacacgaagacaccgcagccttcctgctgaacgacatccgcaaagacatattggactgccgatattgcggatag

SEQ ID NO: 40907 - protein, 517 aa, Neisseria meningitidis
  misc_feature (129)..(134): Xaa can be any naturally occurring amino acid
MPSERSADCCPAHFVVKFRKSTLNCGRRFDRPPINGNRQRKPMIHTEPSAQPSTMDTAAFLKHIESAFRRIFADGIDLMRYLPEDKWLALKQAGLLLPFLDKKYGGRKGSQFEIQEVLRIAGHYGVPVXXXXXXEGALVLQPLQEFGDEAQIAQGLDMVFKGEGGGLGVTEPETSGAAIAREMQSYYEYTDGQTIYVNAAKYWQGNSQSDFLLVAAKERKNGKLAKVIDLLLVPKTYIRCETLASEGLRAVRYAVNRIDAEMPATAVMKLSQSDAAGLRAFQNIFIRSRLQLIGMTHGIMEYTLENLERYVRNDIRFVDYERREIRRRHQVSEILYRYVCHSVSPVAPVAHQLMEANIVKTLATEYTYAAAQMLQKLLGAKGFERGHTAGNIAIDIRPFTIFEGPNDMLYAEIYDQFVRATAEEKEAGMKLDKNQTLLDRLQTDARFAAVARDYTLPEDIRSFLQEHTLTDACALQKVFIGKIIARLFVFVQAEHEDTAAFLLNDIRKDILDCRYCG

SEQ ID NO: 40908 - DNA, 861 bp, Neisseria gonorrhoeae
atgatgatggtgttggcgttggggatgtcgatgccggtttcgatgatggtggaacagagcaacacattgaatctttgctgcaaaaagtcgcgcatgacttgttccagctcgcgctcacgcagttgtccgtgcgccacgccgatacgggcttcgggcagcagggtttccagccgctcgcgcatattctcaatcgtatctacttcattgtgcaggaaaaatacctgtcctccgcgtttgagttcgcgcaacacggcttcgcgcacgctgccttcgctgaacggtttgacaaaggttttcacggcgaggcggcggctcggtgcagtggtaatcagcgagaagtcgcgcagaccttcgagcgccatgctgagggtgcgcggaatcggcgtggcggtcatggttaggatgtcgacattggcgcgcaggcgtttgagctgctctttctgtcgcacgccgaagcggtgttcttcatcgataatcaataaacctaagtttttgaattttatgtcgtcctgcaccaatttgtgcgtaccgataacgatatcgacagtaccgtccgccatgccttcgagcgtggctttggtggctttgctgttgttgaaacgcgaaaggctggcgactttcacggggaaatcggcgaaacggtcggcgaagttttgcgcgtgctgctcgaccagaagcgtggtcggggcgagtacggcgacctgtttgccgcccatcaccgccacaaacgcggcgcgaagggcgacttcggttttgccgaaaccgacatcgccgcacacaagtcggtccatcggcttcgcctgcgtcaaatctttaatcacggcggcgatggcggcggcctggtcttcggtttcctcgtag

SEQ ID NO: 40909 - protein, 286 aa, Neisseria gonorrhoeae
MMMVLALGMSMPVSMMVEQSNTLNLCCKKSRMTCSSSRSRSCPCATPIRASGSRVSSRSRIFSIVSTSLCRKNTCPPRLSSRNTASRTLPSLNGLTKVFTARRRLGAVVISEKSRRPSSAMLRVRGIGVAVMVRMSTLARRRLSCSFCRTPKRCSSSIINKPKFLNFMSSCTNLCVPITISTVPSAMPSSVALVALLLLKRERLATFTGKSAKRSAKFCACCSTRSVVGASTATCLPPITATNAARRATSVLPKPTSPHTSRSIGFACVKSLITAAMAAAWSSVSS

SEQ ID NO: 40910 - DNA, 861 bp, Neisseria meningitidis
atgatgatggtgttggcgttggggatatcgataccggtttcgatgatggtggaacagagcaacacgttaaatcgttgctgcaaaaagtcgcgcatgacttgttccagctcgcgctcgcgcagttgtccgtgcgccacgccgatgcgggcttcgggcagcagggtttccagccgctcgcgcatattttcaatcgtatctacttcattgtgcaggaaaaatacctgtcctccgcgtttgagttcgcgcaacacggcttcgcgcacgctgccttcgctaaagggtttgacaaaggttttgacggcgaggcggcggctgggcgcggtggtaatcagcgagaagtcgcgcagtccttccaacgccatacttaaagtacgcggaatcggcgtggcggtcatggtaaggatatcaacattggcgcgcaggcgtttgagctgctctttctgacgcacgccgaagcggtgttcttcgtcgataatcactaaacctaagtttttgaatttgatgtcgtcctgcaccagtttgtgcgtaccgataacaatatcgaccgtgccgtctgccatgccttccagcgcggctttggtggctttgctgttgttgaaacgcgaaaggctggcgactttcacggggaaatcggcgaaacggtcggcgaagttttgcgcgtgctgctcgaccaaaagcgtggtcggagcaagtacggcgacctgtttgccgcccatcaccgccacaaacgcggcgcgcagggcgacttcggttttgccgaagccgacatcgccgcacacaaggcgatccatcggcttcgcttgcgtcaaatctttaatcacggcggcgatggcggcggcctggtcttcggtttcctcgtag

SEQ ID NO: 40911 - protein, 285 aa, Neisseria meningitidis
MMMVLALGISIPVSMMVEQSNTLNRCCKKSRMTCSSSRSRSCPCATPMRASGSRVSSRSRIFSIVSTSLCRKNTCPPRLSSRNTASRTLPSLKGLTKVLTARRRLGAVVISEKSRSPSNAILKVRGIGVAVMVRISTLARRRLSCSFRTPKRCSSSIITKPKFLNLMSSCTSLCVPITISTVPSAMPSSAALVALLLLKRERLATFTGKSAKRSAKFCACCSTKSVVGASTATCLPPITATNAARRATSVLPKPTSPHTRRSIGFACVKSLITAAMAAAWSSVSS

SEQ ID NO: 40912 - DNA, 861 bp, Neisseria meningitidis
atgatgatggtgttggcgttgggaatgtcgataccggtttcgatgatggtggaacagagcaacacgttaaatcgttgctgcaaaaagtcgcgcatgacttgttccagctcgcgctcgcgcagttgtccgtgcgccacgccgatgcgggcttcgggcagcagggtttccagccgctcacgcatgttttcgatggtatccacttcattgtgcaggaaaaatacttgcccgccgcgtttgagttcgcgcaatacggcttcgcgcacgctgccttcgctgaacggtttgacaaaggttttgacggcgaggcggcggctgggcgcagtggtaatcagcgagaagtcgcgcagtccttccagcgccatacttaaagtacgcggaatcggcgtagcggtcatggtaaggatgtcgacattggcgcgcaggcgtttgagctgctctttctgacgcacgccgaagcggtgttcttcgtcgataatcactaaacctacgtttttgaattttatgtcgtcctgcaccagtttgtgcgtaccgataacaatatcgaccgtgccgtccgccatgccttccagcgcggctttggtggctttgctgttgttgaaacgcgaaaggctggcgactttcacggggaaatcggcgaagcggtcggcaaaattttgcgcgtgctgctcgaccagaagcgtggtcggtgcgagtacggcaacttgtttgccacccattaccgccacaaacgcggcgcgcagggcgacttcggttttgccgaaaccgacatcgccgcacacgaggcggtccatcggcttcgcctgcgtcaaatctttaatcacggcggcgatggcggctgcctggtcttcggtttcttcgtag

SEQ ID NO: 40913 - protein, 285 aa, Neisseria meningitidis
MMMVLALGMSIPVSMMVEQSNTLNRCCKKSRMTCSSSRSRSCPCATPMRASGSRVSSRSRMFSMVSTSLCRKNTCPPRLSSRNTASRTLPSLNGLTKVLTARRRLGAVVISEKSRSPSSAILKVRGIGVAVMVRMSTLARRRLSCSFRTPKRCSSSIITKPTFLNFMSSCTSLCVPITISTVPSAMPSSAALVALLLLKRERLATFTGKSAKRSAKFCACCSTRSVVGASTATCLPPITATNAARRATSVLPKPTSPHTRRSIGFACVKSLITAAMAAAWSSVSS

SEQ ID NO: 40914 - DNA, 312 bp, Neisseria gonorrhoeae
atgcaaaggctcgccgcagacggcatccaaatcttttttgtaggtgtcgatgggcagtttgccttgcgaataaacggtttggttaaagagcgtgcacgctccgtattctttggcaaggtttgccgatgctttgagcaggtaatactgtatggcttcaaaggtacggtgggtcagaccgagcgcggaaccgtcgctgtagcggacaccgtttttcgccagatagtaggcgtagttgatgacaccgatgccgagcgaacggcggtccatagtagaggtacgcgcggcttctaccggatatccctgataatctaa

SEQ ID NO: 40915 - protein, 103 aa, Neisseria gonorrhoeae
MQRLAADGIQIFFVGVDGQFALRINGLVKERARSVFFGKVCRCFEQVILYGFKGTVGQTERGTVAVADTVFRQIVGVVDDTDAERTAVHSRGTRGFYRISLII

SEQ ID NO: 40916 - DNA, 312 bp, Neisseria meningitidis
atgcaaaggctcgccgcagacggcatccaaatcttttttgtaagtgtcgatgggcagtttgccttgcgaataaacggtttggttaaagagcgtgcacgcaccgtattctttggcaaggtttgccgatgctttgagcaggtaatactgtatggcttcaaaggtacggtgggtcagaccgagcgcggaaccgtcgctgtagcggacaccgtttttcgccagataataagcatagttaatcacgccgatgccgagcgaacggcggcccatagtagaggtacgcgcggcttctaccggatatccctgataatctaa

SEQ ID NO: 40917 - protein, 103 aa, Neisseria meningitidis
MQRLAADGIQIFFVSVDGQFALRINGLVKERARTVFFGKVCRCFEQVILYGFKGTVGQTERGTVAVADTVFRQIISIVNHADAERTAAHSRGTRGFYRISLII

SEQ ID NO: 40918 - DNA, 312 bp, Neisseria meningitidis
gtgcaaaggctcgttacacacagcgtccaagtcttttttgtaggtgtcgatgggcagtttgccttgcgaataaacggtttggttaaagagcgtgcacgcaccgtattctttggcaaggtttgccgatgctttgagcaggtaatactgtatggcttcaaaggtacggtgggtcagaccgagcgcggagccgtcgctgtagcggacaccgtttttcgccaaataatacgcatagttgatcacgccgataccgagcgaacggcggcccatagtggaggtacgcgcggcttctaccggatatccctgataatctaa

SEQ ID NO: 40919 - protein, 103 aa, Neisseria meningitidis
VQRLVTHSVQVFFVGVDGQFALRINGLVKERARTVFFGKVCRCFEQVILYGFKGTVGQTERGAVAVADTVFRQIIRIVDHADTERTAAHSGGTRGFYRISLII

SEQ ID NO: 40920 - DNA, 636 bp, Neisseria gonorrhoeae
atgaacaggcgcaacgcgcggatcgaacgggctgtgcgtattgcagtgatcgacgttttgaatgtagatgcgcccggtcccggcacgctcctgcatcagcgtggaaaacaggtcggcagccggaatgatacgcttgcgtatgttcgggtcttgctcgtatttcgtatagagccgctcaaattcgtcttggtcggcaaaaaacgcttcgtacaaccccgaaacctcgttgggcgaaaacagcgtaatgttgccgcccttaatcaggcgggtgtacagcaggcggttgatttgcacgccataatcaagctggcggatacggttgtcttccacgccccggttgtttttcaacaccagcaggctttcggcttcaatatgccacaaggggtagaacaaggttgccgcgccgccgcgcacgccaccttgcgaacaagatttgaccgccgcctgaaacatcttaaagaagggaatgcagccggtatgccgggcttcaccgccccggatttcgctgtccagcccgcggatacgtccggcattgatgccgatgcccgcgcgttgggaaacgtatttcacaatcgcgctggtagtggcattgatggaatccaaactatcgtcgcattcaatcagcacacagcttga

SEQ ID NO: 40921 - protein, 211 aa, Neisseria gonorrhoeae
MNRRNARIERAVRIAVIDVLNVDAPGPGTLLHQRGKQVGSRNDTLAYVRVLLVFRIEPLKFVLVGKKRFVQPRNLVGRKQRNVAALNQAGVQQAVDLHAIIKLADTVVFHAPVVFQHQQAFGFNMPQGVEQGCRAAAHATLRTRFDRRLKHLKEGNAAGMPGFTAPDFAVQPADTSGIDADARALGNVFHNRAGSGIDGIQTIVAFNQHTA

SEQ ID NO: 40922 - DNA, 636 bp, Neisseria meningitidis
atgaacaggcgcgacgcgcggatcgaacgggctgtgcgtattgcagtgatcgacgttttgaatgtagatgcgcccggttccggcacgctcctgcatcagcgtggaaaacaggtcggcagccggaatgatgcgcttgcggatatcagggtcttgctcgtatttcgtatagagccgctcaaattcgtcttggtcggcaaaaaacgcttcgtacaatcccggaacctcgttgggcgaaaacagcgtaatgttgccgcccttaatcaggcgggtgtacagcaggcggttgatttgcacgccgtaatcaagctgacggatacggttgtcttccacaccgcggttgtttttcaacaccagcaggctttcggcttcgatatgccacaaggggtagaacaaggttgccgcgccgccgcgcacgccgccttgcgaacaggatttgaccgccgcctgaaacattttaaagaagggaatgcagccggtatgccgcgcttcgccgccccggatttcgctgtccaaaccgcggatacgtccggcattgatgccgatgcccgcacgctgggaaacgtatttcacaatcgcgctggtagtggcattgatggaatccaaactatcgtcgcattcaatcagcacacagcttga

SEQ ID NO: 40923 - protein, 211 aa, Neisseria meningitidis
MNRRDARIERAVRIAVIDVLNVDAPGSGTLLHQRGKQVGSRNDALADIRVLLVFRIEPLKFVLVGKKRFVQSRNLVGRKQRNVAALNQAGVQQAVDLHAVIKLTDTVVFHTAVVFQHQQAFGFDMPQGVEQGCRAAAHAALRTGFDRRLKHFKEGNAAGMPRFAAPDFAVQTADTSGIDADARTLGNVFHNRAGSGIDGIQTIVAFNQHTA

SEQ ID NO: 40924 - DNA, 636 bp, Neisseria meningitidis
atgaacaggcgcaacgcgcggatcgaacgggctgtgcgtattgcagtgatcgacgttttgaatgtagatgcgcccggttccggcacgctcctgcatcagcgtggaaaacaggtcggcagccggaatgatgcgcttgcggatatcagggtcttgctcgtatttcgtatagagccgctcaaattcgtcttggtcggcaaaaaacgcttcgtacaatcccggaacctcgttgggcgaaaacagcgtaatgttgccgcccttaatcaggcgggtgtacagcaggcggttgatttgcacgccgtaatcaagctgacggatacggttgtcttccacgccccggttgtttttcaacaccagcaggctttcggcttcgatatgccacaaggggtagaacaaggttgccgcgccgccgcgcacgccaccttgcgaacaggatttgactgccgcctgaaacattttaaagaagggaatgcagccggtatgccgtgcttcgccgccccggatttcgctgtccagtccgcggatacgtccggcattgatgccgatgcccgcacgctgggaaacgtatttcacaatcgcgctggtagtggcgttgatggaatccaggctgtcgtcgcattcgatcaatacgcagcttga

SEQ ID NO: 40925 - protein, 211 aa, Neisseria meningitidis
MNRRNARIERAVRIAVIDVLNVDAPGSGTLLHQRGKQVGSRNDALADIRVLLVFRIEPLKFVLVGKKRFVQSRNLVGRKQRNVAALNQAGVQQAVDLHAVIKLTDTVVFHAPVVFQHQQAFGFDMPQGVEQGCRAAAHATLRTGFDCRLKHFKEGNAAGMPCFAAPDFAVQSADTSGIDADARTLGNVFHNRAGSGVDGIQAVVAFDQYAA

SEQ ID NO: 40926 - DNA, 312 bp, Neisseria gonorrhoeae
atgcttgccatactgttgtctgcaatactgggactggtatcaacaactgccgctgccggtacgtcagaacccgcccaccgacataccaaacatatcagcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgcaccctgccttatgcggaacagaaaatccaatgccgggcggcttatgaggctttcgatgatttcgacggcggcaggttccgccgttaa

SEQ ID NO: 40927 - protein, 103 aa, Neisseria gonorrhoeae
MLAILLSAILGLVSTTAAAGTSEPAHRHTKHISKANKQMLHPECRKYLERRAAWYRSQGNVQELRENKKARKAFRTLPYAEQKIQCRAAYEAFDDFDGGRFRR

SEQ ID NO: 40928 - DNA, 312 bp, Neisseria meningitidis
atgcttgccatactgttgtctgcaatattgggactggtatcgacaactgccgctgccggtacgtcagaacccgcccaccgcgataccaaacatatccgcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgctccctgccttatgcggaacagaaaatccaatgccgggcggcttatgaggctttcgatgatttcgacggcggcagtttccgccgttaa

SEQ ID NO: 40929 - protein, 103 aa, Neisseria meningitidis
MLAILLSAILGLVSTTAAAGTSEPAHRDTKHIRKANKQMLHPECRKYLERRAAWYRSQGNVQELRENKKARKAFRSLPYAEQKIQCRAAYEAFDDFDGGSFRR

SEQ ID NO: 40930 - DNA, 312 bp, Neisseria meningitidis
atgcttgccatactgttgtctgcaatattgggactggtatcgacaactgccgctgccggtacgtcagaacccgcccaccgcgataccaaacatatccgcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgctccctgccttataaggaacagaaaacccaatgccgggcggcttatgaggctttcgatgatttcgacggcagcaggttccgccgttaa

SEQ ID NO: 40931 - protein, 103 aa, Neisseria meningitidis
MLAILLSAILGLVSTTAAAGTSEPAHRDTKHIRKANKQMLHPECRKYLERRAAWYRSQGNVQELRENKKARKAFRSLPYKEQKTQCRAAYEAFDDFDGSRFRR

SEQ ID NO: 40932 - DNA, 1398 bp, Neisseria gonorrhoeae
atgtccaaactcaaaaccatcgccctgaccgcatcaggtctgtccgtttgtccgggtttcctatatgcccaaaacacctcatcacaccaagtcggtttagcgattatgcggttaaactcttcaatactcgacctgccaccgacaaaacaatatttccaatccggcagcctgtgggacgagctgcgccaaggcttccggatgggcgaagtcaatcccgaactggtacgccgccacgaaagcaaattcatcgcaagccgcagctatttcgacagggtcgtcaaccggagccgaccctatatgtaccatatcgccaacgaagtcaaaaaacgcaatatgcccgccgaagccgccctgcttcccttcatcgaaagcgcgttcgtcaccaaagccaaatcacacgtcggcgcatcgggcctgtggcagttcatgcccgctaccggcaggcattacggcttggaaaaaacaccggtttacgacggcaggcacgacgtttacgcagctaccgatgccgcactcaactatctgcaatatctctatggactgttcggcgactggccgctcgcctttgccgcctacaactggggtgaaggcaacgtcggacgcgccgtcaaccgcgcccgcgaccaagggctcgaaccgacctacgaaaacctgcgtatgcccaacgaaacgcgcaactatgtccccaagctgctcgccgtgcgcaacattattgccaccccccaatctttcggcatgaatatcagcgacatagacaacaaaccctattttcaggcagtcgaaccgggccgtccgctcgacaacgaagccatcgcccggcttgccggcatcacgcaaagcgagctgctcgccctgaatcctgcattcaacgtccccgcgttcatccccaaaaacaaacgcaaactgctgcttcctgtcgcgtccgtccaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaagacccttcatacggcatcggaatccgtcgtttccatcgacatcgacaatacgcccgacacctaccgttccaatatgccggcaggcacggtgaacgtcagcattgcccgaatccaacccgccgccgcacagacagcggacattaccgtcgcacctttgccgcaagaaaccgtccgtacgggaacccgatccccttgtccgcattaccgaacccgcccttgcgacagccgcagcgcaacctcaaaccgaaaaacagactgccatgccgtctga

SEQ ID NO: 40933 - protein, 465 aa, Neisseria gonorrhoeae
MSKLKTIALTASGLSVCPGFLYAQNTSSHQVGLAIMRLNSSILDLPPTKQYFQSGSLWDELRQGFRMGEVNPELVRRHESKFIASRSYFDRVVNRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAVNRARDQGLEPTYENLRMPNETRNYVPKLLAVRNIIATPQSFGMNISDIDNKPYFQAVEPGRPLDNEAIARLAGITQSELLALNPAFNVPAFIPKNKRKLLLPVASVQTFQSNYLNAAPDSLFSWEVYTPAAKTSLSDISTATGMSIADIKRLNNLNGNLVNAGRSILVAKNGKTLHTASESVVSIDIDNTPDTYRSNMPAGTVNVSIARIQPAAAQTADITVAPLPQETVRTGTRSPCPHYRTRPCDSRSATSNRKTDCHAV

SEQ ID NO: 40934 - DNA, 1397 bp, Neisseria meningitidis
atgtccaaactcaaaaccatcgctctgaccgcatcaggtctgtccgtttgtccgggtttcctatacgcccaaaacacctcatcacaccaaatcggtttggcgattatgcgcttaaactcttcaatactcgacctgcccccgacaaaacaatatttccaatccggcagcctgtggggcgagctgcgccaaggcttccggatgggcgaagtcaatcccgaactggtacgccgccacgaaagcaaattcatcgcaagccacagctatttcaacagggtcatcaaccggagtagaccctatatgtaccatatcgccaacgaagtcaaaaaacgcaatatgcccgccgaagccgccctgcttcccttcatcgaaagcgcgttcgtcaccaaagccaaatcacacgtcggcgcatcaggattatggcagtttatgcccgctaccggcaggcattacggcctggaaaaaacaccggtttacgacggcaggcacgacgtttacgccgccaccgatgccgcactcaactatctgcaatacctctatggactgttcggcgactggccgcttgcctttgccgcctacaactggggtgaaggcaacgtcggacgcgccatcaaccgcgcccgcgcccaagggctcgaaccgacctacgaaaacctgcgtatgcccaacgaaacgcgcaactatgtccccaagctgctcgccgtgcgcaacattattgccactccccaatctttcggcatgaatatcagcgacatagacaacaaaccctattttcaggcagtcgaaccggatcgtccgctcgacaacgaagccatcgcccggcttgccggcatcacgcaaagcgagctgctcgccctaaaccccgcattcaacgtccccgcgtttatccccaaaagcaaacgcaaactgctgcttcctgtcgcgtccgtacaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaaaacccttcagacggcatcggaatccgtcgtttccatcgacatcgacaatacgcccgacacctaccgttccaatatgccggcaggcacggtgaacgtcggcattgcccgaatccgacccgccgccgcacagacagcggacattaccgtcgcacctttgccgcagaaaaccgtccgtacggaacccgatccccttgtccgtattgccgaacctgcccttgcgacagccgcagcgcaacctcaaaccgaaaaacagaccgccatgccgtctga

SEQ ID NO: 40935 - protein, 465 aa, Neisseria meningitidis
  misc_feature (436)..(436): Xaa can be any naturally occurring amino acid
MSKLKTIALTASGLSVCPGFLYAQNTSSHQIGLAIMRLNSSILDLPPTKQYFQSGSLWGELRQGFRMGEVNPELVRRHESKFIASHSYFNRVINRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAINRARAQGLEPTYENLRMPNETRNYVPKLLAVRNIIATPQSFGMNISDIDNKPYFQAVEPDRPLDNEAIARLAGITQSELLALNPAFNVPAFIPKSKRKLLLPVASVQTFQSNYLNAAPDSLFSWEVYTPAAKTSLSDISTATGMSIADIKRLNNLNGNLVNAGRSILVAKNGKTLQTASESVVSIDIDNTPDTYRSNMPAGTVNVGIARIRPAAAQTADITVAPLPQKTVRTXTRSPCPYCRTCPCDSRSATSNRKTDRHAV

SEQ ID NO: 40936 - DNA, 1397 bp, Neisseria meningitidis
atgtccaaactcaaaaccatcgccctgaccgcgtcaggtctgtccgtttgtccgggtttcctatacgcccaaaacacctcatcacaccaaatcggtttggcgattatgcgcttaaactcttcaatactcgacctgccaccgacaaaacaatatttccaatccggcagcctgtggagcgagctgcgccaaggcttccggatgggcgaagtcaatcccgaactggtacgccgccacgaaagcaaattcatcgcaagccacagctatttcaacagggtcatcaaccggagtagaccctatatgtaccatatcgccaacgaagtcaaaaaacgcaatatgcccgccgaagccgccctgcttcccttcatcgaaagcgcgttcgtcaccaaagccaaatcacacgtcggcgcatcgggcctgtggcagttcatgcccgctaccggcaggcattacggcctggaaaaaacaccggtttacgacggcaggcacgacatttacgccgccaccgatgccgcactcaactatctgcaatacctctatggactgttcggcgactggccgctcgcctttgccgcctacaactggggtgaaggcaacgtcggacgcgccatcaaccgcgcccgcgcccaagggctcgaaccgacctacgaaaacctgcgtatgcccaacgaaacgcgcaactatgttcccaagctgctcgccgtgcgcaacatcattgccgccccccaatctttcggcatgaatatcagcgacatagacaacaaaccgtattttcaggcagtcgaaccggaccgtccgctcgacaacgaagccatcgcccggcttgccggcatcacgcaaagcgagctgctcgccctaaaccccgcattcaacgtccccgcgttcatccccaaaagcaaacgcaaactgctgcttcctgtcgcgtccgtacaaaccttccaaagcaactacctcaacgccgcacccgacagcctgttttcatgggaagtctatacgcctgccgccaaaaccagcttgtccgacatctcgacggcaaccggcatgagcattgccgacatcaaacgcctcaacaacctgaacggcaaccttgtcaacgcaggacgcagcatccttgtcgccaagaacggcaaaacccttcagacggcatcggaatccgtcgtttccatcgacatcgacaatacgcccaacacctaccgttccaatatgccggcaggcacggtgaacgtcggcattgcccgaatccgacccgccgccgcacagacagcggacattaccgtcgcacctttgccgcagaaaaccgtccgtacggaacccgatccccttgtccgtattgccgaacctgcccttgcgacagccgcagcgcaacctcaaaccgaaaaacagaccgccatgccgtctga

SEQ ID NO: 40937 - protein, 465 aa, Neisseria meningitidis
  misc_feature (436)..(436): Xaa can be any naturally occurring amino acid
MSKLKTIALTASGLSVCPGFLYAQNTSSHQIGLAIMRLNSSILDLPPTKQYFQSGSLWSELRQGFRMGEVNPELVRRHESKFIASHSYFNRVINRSRPYMYHIANEVKKRNMPAEAALLPFIESAFVTKAKSHVGASGLWQFMPATGRHYGLEKTPVYDGRHDIYAATDAALNYLQYLYGLFGDWPLAFAAYNWGEGNVGRAINRARAQGLEPTYENLRMPNETRNYVPKLLAVRNIIAAPQSFGMNISDIDNKPYFQAVEPDRPLDNEAIARLAGITQSELLALNPAFNVPAFIPKSKRKLLLPVASVQTFQSNYLNAAPDSLFSWEVYTPAAKTSLSDISTATGMSIADIKRLNNLNGNLVNAGRSILVAKNGKTLQTASESVVSIDIDNTPNTYRSNMPAGTVNVGIARIRPAAAQTADITVAPLPQKTVRTXTRSPCPYCRTCPCDSRSATSNRKTDRHAV

SEQ ID NO: 40938 - DNA, 1008 bp, Neisseria gonorrhoeae
atgatcgaattggacggtactgaaaacaaaggcaatttgggtgcgaatgcgactttggcggtctctatggcggttgcacgcgccgctgccgaagactcaggcctgccgctttaccgctacttggggggcgcaggtccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagtaaaggcttcccgaccacagtcggcgacgaaggcggtttcgcccccaacctgaacagccacaaagaagccctgcaactgatggtcgaagcggccgaagccgccggctacaaggcgggcgaagacgtattattcgcattggactgcgcgtccagcgagttctacaaagacggcaaataccacttggaagccgaaggccgctcctacaccaacgcggaatttgccgaatacttggaaggcttggttaacgaattcccgattatttccattgaagacgggatggacgaaaacgactgggaaggctggaaactgctgaccgaaaaattgggcaaaaaagttcaattggtcggcgacgacttgttcgtaaccaatccgaaaattcttgccgaaggcatcgaaaaaggcgtagcaaacgcattgctggtcaaagtcaaccaaatcggtactttaagcgaaaccctgaaagccgtcgatctggcaaaatgcaaccgctacgccagcgtgatgagccaccgctccggcgaaaccgaagacagtaccattgccgacttggcagtcgccaccaactgtatgcagattaaaaccggttctttgagccgttccgaccgcatggcgaaatacaaccaactgctgcgtatcgaggaagaattggcggaagccgcctactaccccggcaaagccgcattctaccaactgggcaaataa

SEQ ID NO: 40939 - protein, 335 aa, Neisseria gonorrhoeae
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 40940 - DNA, 1008 bp, Neisseria meningitidis
atgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcctccagcgagttctacaaagacggcaaataccacttggaagccgaaggccgctcctacaccaacgcggaatttgccgaatatctggaaggcctggtcaacgagttccccatcatctccatcgaagacggcatggatgaaaacgactgggaaggctggaaactgctgaccgaaaaactgggcggtagagttcaattggttggcgacgacttgttcgtaaccaatccaaaaatcttggccgaaggcatcgaaaaaggcgtagcaaacgcattgctggtcaaagtcaatcaaatcggtactttgagcgagaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 40941 - protein, 335 aa, Neisseria meningitidis
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 40942 - DNA, 1008 bp, Neisseria meningitidis
atgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcgtccagcgagttctacaaagacggcaaataccacttggaagccgaaggccgctcctacaccaacgcggaatttgccgaatatctggaaggcctggtcaacgagttccccatcatctccatcgaagacgggatggatgaaaacgactgggaaggctggaaactgctgaccgaaaaactgggcggcaaagtccaactcgttggcgacgacctcttcgttaccaacccgaaaatccttgccgaaggcattgaaaaaggcgtggcaaacgcactattggtcaaagtcaaccaaatcggtactttgagtgaaaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 40943 - protein, 335 aa, Neisseria meningitidis
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGKVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 40944 - DNA, 1287 bp, Neisseria gonorrhoeae
atgagcgcaatcgttgatattttcgcccgcgaaattttggactcacgcggcaaccccacagtcgagtgtgatgtattgctcgaatccggcgtaatgggacgtgcggccgtaccgagcggcgcatccaccggtcagaaagaagctttggaacttcgcgacggcgacaaatcccgctattccggcaaaggcgtattgaaggccgtcgaacacgtcaacaaccaaatcgcccaagccctcatcggtatcgatgccaacgagcaatcttatatcgaccaaatcatgatcgaattggacggtactgaaaacaaaggcaatttgggtgcgaatgcgactttggcggtctctatggcggttgcacgcgccgctgccgaagactcaggcctgccgctttaccgctacttggggggcgcaggtccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagtaaaggcttcccgaccacagtcggcgacgaaggcggtttcgcccccaacctgaacagccacaaagaagccctgcaactgatggtcgaagcggccgaagccgccggctacaaggcgggcgaagacgtattattcgcattggactgcgcgtccagcgagttctacaaagacggcaaataccacttggaagccgaaggccgctcctacaccaacgcggaatttgccgaatacttggaaggcttggttaacgaattcccgattatttccattgaagacgggatggacgaaaacgactgggaaggctggaaactgctgaccgaaaaattgggcaaaaaagttcaattggtcggcgacgacttgttcgtaaccaatccgaaaattcttgccgaaggcatcgaaaaaggcgtagcaaacgcattgctggtcaaagtcaaccaaatcggtactttaagcgaaaccctgaaagccgtcgatctggcaaaatgcaaccgctacgccagcgtgatgagccaccgctccggcgaaaccgaagacagtaccattgccgacttggcagtcgccaccaactgtatgcagattaaaaccggttctttgagccgttccgaccgcatggcgaaatacaaccaactgctgcgtatcgaggaagaattggcggaagccgcctactaccccggcaaagccgcattctaccaactgggcaaataa

SEQ ID NO: 40945 - protein, 428 aa, Neisseria gonorrhoeae
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 40946 - DNA, 1287 bp, Neisseria meningitidis
atgagcgcaatcgttgatattttcgcccgcgaaattttggactcacgcggcaaccccacagtcgagtgtgatgtattgctcgaatccggcgtaatgggacgcgcagccgtaccgagcggcgcgtccaccggtcaaaaagaggctttggaacttcgcgacggcgacaaatcccgttattcgggcaagggcgtattgaaggcggtcgaacacgtcaacaaccaaatcgcccaagccctcattggtatcgatgccaacgagcaatcttatatcgaccaaatcatgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcctccagcgagttctacaaagacggcaaataccacttggaagccgaaggccgctcctacaccaacgcggaatttgccgaatatctggaaggcctggtcaacgagttccccatcatctccatcgaagacggcatggatgaaaacgactgggaaggctggaaactgctgaccgaaaaactgggcggtagagttcaattggttggcgacgacttgttcgtaaccaatccaaaaatcttggccgaaggcatcgaaaaaggcgtagcaaacgcattgctggtcaaagtcaatcaaatcggtactttgagcgagaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 40947 - protein, 428 aa, Neisseria meningitidis
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 40948 - DNA, 1287 bp, Neisseria meningitidis
atgagcgcaatcgttgatattttcgcccgcgaaattttggactcacgcggcaaccccacagtcgagtgtgatgtattgctcgaatccggcgtaatgggacgcgcagccgtaccgagcggcgcgtccaccggtcaaaaagaggctttggaacttcgcgacggcgacaaatcccgttattcgggcaagggcgtattgaaggcggtcgaacacgtcaacaaccaaatcgcccaagccctcattggtatcgatgccaacgagcaatcttatatcgaccaaatcatgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcgtccagcgagttctacaaagacggcaaataccacttggaagccgaaggccgctcctacaccaacgcggaatttgccgaatatctggaaggcctggtcaacgagttccccatcatctccatcgaagacgggatggatgaaaacgactgggaaggctggaaactgctgaccgaaaaactgggcggcaaagtccaactcgttggcgacgacctcttcgttaccaacccgaaaatccttgccgaaggcattgaaaaaggcgtggcaaacgcactattggtcaaagtcaaccaaatcggtactttgagtgaaaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 40949 - protein, 428 aa, Neisseria meningitidis [sequence omitted]

SEQ ID NO: 40950 - DNA, 492 bp, Neisseria gonorrhoeae
atggcggcggaaccgatgcggatgccggaggtaacgtacggtttttccggatcgttcgggatggcgtttttgttgacggtgatgtgcgctttgcccaaagcggcttcggcggctttgccggtgattttcatcggttgcaggtcgacgaggaaaacgtggctttcggtgcggccggaaacgatgcgcaaaccgcgtttaaccaactcttccgccatgacggcagcattgattttcacttgttttgcgtattgtttgaactcgggttgcaacgcttctttaaacgctacggctttggcggcgataacgtgcatcaacggaccgccttgcaggcttgggaagatggaagagttcagcgctttttcgtgggtattgtcacggcacaaaatcacaccgccgcgagggccgcgtagggttttgtgggtggtagtggttacgaagtcgcagaatggcacggggttaggatattcgccgccggcaaccagtccggcatag

SEQ ID NO: 40951 - protein, 163 aa, Neisseria gonorrhoeae
MAAEPMRMPEVTYGFSGSFGMAFLLTVMCALPKAASAALPVIFIGCRSTRKTWLSVRPETMRKPRLTNSSAMTAALIFTCFAYCLNSGCNASLNATALAAITCINGPPCRLGKMEEFSAFSWVLSRHKITPPRGPRRVLWVVVVTKSQNGTGLGYSPPATSPA

SEQ ID NO: 40952 - DNA, 492 bp, Neisseria meningitidis
atggcagcggagccgatgcggatgccggaggtaacgaagggtttttccggatcgttcggaatggcgtttttgttgacggtgatgtgcgctttgcccaaagcggcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcggaccgccttgcaggcttgggaagatggaagagttcaacgctttttcgtgggtattgtcgcggcacaaaattacgccgccgcgaggaccgcgcagggttttgtgggtggtggtggtcacgaagtcgcagaacggcaccgggttgggatattcgccgccggcaaccagaccggcatag

SEQ ID NO: 40953 - protein, 163 aa, Neisseria meningitidis
MAAEPMRMPEVTKGFSGSFGMAFLLTVMCALPKAASAALPVIFIGCRSTRKTWLSVRPETMRKPRLTNSSAMAAALIFTCFAYCLNSGCNASLNATALAAITCISGPPCRLGKMEEFNAFSWVLSRHKITPPRGPRRVLWVVVVTKSQNGTGLGYSPPATRPA

SEQ ID NO: 40954 - DNA, 492 bp, Neisseria meningitidis
atggcggcggaaccgatgcggatgccggaggtaacgaagggtttttccggatcattcgggatggcgtttttgttgacagtgatgtgcgctttgcccaaagcagcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcgggccaccttgcaggcttgggaagatggaagagttcaacgctttttcgtgggtattgtcgcggcacaaaattacgccgccgcgaggaccgcgcagggttttgtgggtggtggtggtaacgaagtcgcagaacggcacgggattgggatattcgccgccggcaaccagaccggcatag

SEQ ID NO: 40955 - protein, 163 aa, Neisseria meningitidis; identical to SEQ ID NO: 40953

SEQ ID NO: 40956 - DNA, 435 bp, Neisseria gonorrhoeae
atgccgcgtttctccggttcgatttcttcgatgatttccatcgcgcggacttttggcgcgccggagagtgtgccggcagggaaggtggcggcgaggatgtccatattggtaacgccctctttcaaacagccttcgacgttggaaacgatgtgcatcacatgggagtatttttcaatcaccattttgtcggtgactttgacttcgcctgttttgctgatgcgtccgacatcgttgcgccccaaatcgataagcataacgtgttcggcgatttctttggcgtcgcttaacaaatcttgttcgttggcaaggtcttcggcgggggttttgccgcgcaggcgcgtgccggcgatggggcggacgatgacgtcatcgcgttcgcggcggacgaggatttcgggcgaggaaccgacgatgtggaaatcgccgaaatcgtag

SEQ ID NO: 40957 - protein, 144 aa, Neisseria gonorrhoeae
MPRFSGSISSMISIARTFGAPESVPAGKVAARMSILVTPSFKQPSTLETMCITWEYFSITILSVTLTSPVLLMRPTSLRPKSISITCSAISLASLNKSCSLARSSAGVLPRRRVPAMGRTMTSSRSRRTRISGEEPTMWKSPKS

SEQ ID NO: 40958 - DNA, 435 bp, Neisseria meningitidis
atgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgataacgtcgttgcgttcgcgtcggacgaggatttcgggcgaggagccgacgatgtggaaatcgccgaaatcgtag

SEQ ID NO: 40959 - protein, 144 aa, Neisseria meningitidis
MPRLLGSTSSMISMARTLGAPESVPAGKVAARMSMLVMPSFRRPSTLETMCITWEYFSITILSVTLTSPVLLMRPTSLRPKSINMTCSAISLASLNKSCSLARSSAGVLPRRRVPAMGRTITSLRSRRTRISGEEPTMWKSPKS

SEQ ID NO: 40960 - DNA, 435 bp, Neisseria meningitidis
atgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgatgacatcgtcgcgttcgcggcggacgaggatttcgggcgaggagccgacgatgtggaaatcgccgaaatcgtag

SEQ ID NO: 40961 - protein, 144 aa, Neisseria meningitidis
MPRLLGSTSSMISMARTLGAPESVPAGKVAARMSMLVMPSFRRPSTLETMCITWEYFSITILSVTLTSPVLLMRPTSLRPKSINMTCSAISLASLNKSCSLARSSAGVLPRRRVPAMGRTMTSSRSRRTRISGEEPTMWKSPKS

SEQ ID NO: 40962 - DNA, 1137 bp, Neisseria gonorrhoeae
atgaacacaccccccatccttcctcccgccatgctcggcatcctcggcggcggacaattaggcagaatgtttgccgttgccgctaaaaccatgggctacaaagtaaccgttctcgatcccgacccgaatgcgccggcggcggaatttgccgaccgccatttgtgcgcgccgtttgacgaccgggccgcgttggacgaattggcaaaatgcgcggcggttacgaccgaatttgaaaacgtcaatgccgacgcgatgcgctctctggcaaagcataccaacgtttcccccagcggcgactgcgtgtccattgcacaaaaccgcattcaggaaaaagcgtggatacgcaaagcaggcttgcaaaccgcgccgtatcaggcggtttgcaaggccgaagacattactgaagcaagcgcgcaatttttgcccggcatcctgaaaacggctacgttgggctacgacggcaaaggtcaaatccgcgtcaaaacgttggacgaactcaaagccgcgtttgccgaacacggcggcgtggattgcgttttggaaaaaatggtggacttgcgcggcgagatttccgtgatcgtatgccgtctgaacgatgaaaacgtgcaaaccttcgaccccgccgaaaacatccacgaaaacggcatcttggcttattccatcgtccccgcgcggctgagtgccgacgtgcagcaacaggcgcggcagacggcgcaacgcttggcggacgaattggattatgtcggcgtattggcggtagaaatgtttgttgtcggcgacacacatgaattgctcgtcaatgaaaccgccccgcgcacgcacaattccggccaccatacgatagatgcctgcgccgcagaccagttccaacagcaggtacgcattatgtgcaacctgccgcccgccgacaccaaattattatccccttgctgtatggcgaatattttgggcgacgtttggcaggaagatggcggcgaaccggattggctgccgttgcaaagccggccgaatgcacacctgcacctatacggaaaaaaaaccgcacagaaaggtcggaaaatgggacactttaccgttttgaccaccgattcggacaccgcatttcaagaagcaaaaaaactgcatcagtccctataa

SEQ ID NO: 40963 - protein, 378 aa, Neisseria gonorrhoeae
MNTPPILPPAMLGILGGGQLGRMFAVAAKTMGYKVTVLDPDPNAPAAEFADRHLCAPFDDRAALDELAKCAAVTTEFENVNADAMRSLAKHTNVSPSGDCVSIAQNRIQEKAWIRKAGLQTAPYQAVCKAEDITEASAQFLPGILKTATLGYDGKGQIRVKTLDELKAAFAEHGGVDCVLEKMVDLRGEISVIVCRLNDENVQTFDPAENIHENGILAYSIVPARLSADVQQQARQTAQRLADELDYVGVLAVEMFVVGDTHELLVNETAPRTHNSGHHTIDACAADQFQQQVRIMCNLPPADTKLLSPCCMANILGDVWQEDGGEPDWLPLQSRPNAHLHLYGKKTAQKGRKMGHFTVLTTDSDTAFQEAKKLHQSL

SEQ ID NO: 40964 - DNA, 1137 bp, Neisseria meningitidis
atgaaaaacatatctctttctccgcccgccatgcttggcatcctcggcggcggacaattaggcagaatgtttaccgttgccgccaaaaccatgggctacaaagtaaccgttctcgaccccgatccggacgcgccggcagcagaatttgccgaccgccatttgtgcgcgccgtttaacgaccaagctgctttggacgaattggcaaaatgcgcggcggtgaccactgaatttgaaaacgtcaatgccgatgcgatgcgctttttggcaaaacataccaatgtttcccctagcggcgattgtgtggcgattgcacaaaaccgcattcaggaaaaggcatggatacgcaaagcgggattgcaaaccgcgccgtatcaagtggtttgtaaggctgaagacatcactgaagcaagcgcgcaatttttgcccggcatcctgaaaacggctacgttgggctacgacggcaaaggtcaaatccgcgtaaaaacattggatgaactcaaagccgcgtttgccgaacacggcggcgtggattgcgttttggaaaaaatggtggatttgcgcagtgaaatttccgtaatcgtatgccgtttgaacaatgacaacgtgcaaactttcgaccctgccgaaaacatccacgaaaacggcatcttggcttattccatcgtccccgcgcgactgagtgccgacgtgcagcaacaggcgcggcagatggcgcaacgcttggcggacgaattggattatgtcggcgtattggcggtagaaatgtttgttgtcggtgacacgcatgaattggtcgtcaacgaaatcgccccgcgcccgcacaattccggacaccatacgatagatgcctgcgcagcagaccagttccagcagcaggtacgcattatgtgcaacctgccgcctgccgataccaaattactgagttcttgctgtatggcaaatattttgggcgacgtttggcaggaagacggcggcgaaccggattggctgcccttgcaaagccatccgaatgcacacctgcacctttacggcaaaaaaaccgcgcacaaagggcggaaaatgggacactttaccgttttaaccaccgattcggacaccgcatttcaagaagcaaaaaaactgcatcagtccctataa

SEQ ID NO: 40965 - protein, 378 aa, Neisseria meningitidis
MKNISLSPPAMLGILGGGQLGRMFTVAAKTMGYKVTVLDPDPDAPAAEFADRHLCAPFNDQAALDELAKCAAVTTEFENVNADAMRFLAKHTNVSPSGDCVAIAQNRIQEKAWIRKAGLQTAPYQVVCKAEDITEASAQFLPGILKTATLGYDGKGQIRVKTLDELKAAFAEHGGVDCVLEKMVDLRSEISVIVCRLNNDNVQTFDPAENIHENGILAYSIVPARLSADVQQQARQMAQRLADELDYVGVLAVEMFVVGDTHELVVNEIAPRPHNSGHHTIDACAADQFQQQVRIMCNLPPADTKLLSSCCMANILGDVWQEDGGEPDWLPLQSHPNAHLHLYGKKTAHKGRKMGHFTVLTTDSDTAFQEAKKLHQSL

SEQ ID NO: 40966 - DNA, 1137 bp, Neisseria meningitidis
atgaaaaacatatctctttctccgcccgccatgctcggcattcttggcggcggacaattaggcagaatgtttactgttgctgccaaaaccatgggctacaaagtaaccgtactcgatcccaacccgaatgcgccggcagcggaatttgccgaccgccatttgtgtgcgccgtttgacaaccaaaccgctttggaagaattggcaaaatgtgcggctgttacgaccgagttcgaaaacgtcaatgccgatgcgatgcgttttctcgccaaacataccaatgtttcccccagcggcgactgcgttgccatcgcgcaaaaccgcattcaggaaaaggcatggatacgcaaagcaggcctgcaaaccgcgccgtatcaagcaatttgcaaagccgaagacatcactgaagaaagcatacaatttctgcccggcatcctgaaaaccgctacattgggctatgacggcaaaggccaaatccgcgtcaaaacggtggatgaactcaaagccgcgtttgccgaacaccgcggcgtggattgcgttttggaaaaaatggtggacttgcgcggcgaaatttccgttatcgtatgccgtctgaacaatgacaacgtgcaaactttcgatcctgccgaaaacattcacgaaaacggtatcctcgcctactccatcgtcccagcccgactgagtgccgacattcagcaacaggcgcgacaaatggcgcagcgtttggccgatgaattgaactacgtcggcgtattggcggtagaaatgtttgttgtcggcgacacgcatgaattggtcgtcaacgaaatcgcgccgcgtccgcacaattccggccaccataccgtcgacgcctgcgcggcagaccaattccagcaacaggtccgcctgatgtgcaacctgccacctgctgacaccaaattgctgagttcttgctgtatggcgaatattttgggcgacgtttggcaggaagacggcggcgaaccggattggtttcccctgcaaagccggccggacgcgcacctgcacctttacggcaaaaaaaccgcgcacaaagggcggaaaatgggacactttaccattttaagcaccgattcggacaccgcatttcaagaagcaaaaaaactgcatcagtccctataa

SEQ ID NO: 40967 - protein, 378 aa, Neisseria meningitidis
MKNISLSPPAMLGILGGGQLGRMFTVAAKTMGYKVTVLDPNPNAPAAEFADRHLCAPFDNQTALEELAKCAAVTTEFENVNADAMRFLAKHTNVSPSGDCVAIAQNRIQEKAWIRKAGLQTAPYQAICKAEDITEESIQFLPGILKTATLGYDGKGQIRVKTVDELKAAFAEHRGVDCVLEKMVDLRGEISVIVCRLNNDNVQTFDPAENIHENGILAYSIVPARLSADIQQQARQMAQRLADELNYVGVLAVEMFVVGDTHELVVNEIAPRPHNSGHHTVDACAADQFQQQVRLMCNLPPADTKLLSSCCMANILGDVWQEDGGEPDWFPLQSRPDAHLHLYGKKTAHKGRKMGHFTILSTDSDTAFQEAKKLHQSL

SEQ ID NO: 40968 - DNA, 780 bp, Neisseria gonorrhoeae
atggtggccggaattgtgcgtgcgcggggcggtttcattgacgagcaattcatgtgtgtcgccgacaacaaacatttctaccgccaatacgccgacataatccaattcgtccgccaagcgttgcgccgtctgccgcgcctgttgctgcacgtcggcactcagccgcgcggggacgatggaataagccaagatgccgttttcgtggatgttttcggcggggtcgaaggtttgcacgttttcatcgttcagacggcatacgatcacggaaatctcgccgcgcaagtccaccattttttccaaaacgcaatccacgccgccgtgttcggcaaacgcggctttgagttcgtccaacgttttgacgcggatttgacctttgccgtcgtagcccaacgtagccgttttcaggatgccgggcaaaaattgcgcgcttgcttcagtaatgtcttcggccttgcaaaccgcctgatacggcgcggtttgcaagcctgctttgcgtatccacgctttttcctgaatgcggttttgtgcaatggacacgcagtcgccgctgggggaaacgttggtatgctttgccagagagcgcatcgcgtcggcattgacgttttcaaattcggtcgtaaccgccgcgcattttgccaattcgtccaacgcggcccggtcgtcaaacggcgcgcacaaatggcggtcggcaaattccgccgccggcgcattcgggtcgggatcgagaacggttactttgtagcccatggttttagcggcaacggcaaacattctgcctaa

SEQ ID NO: 40969 - protein, 259 aa, Neisseria gonorrhoeae
MVAGIVRARGGFIDEQFMCVADNKHFYRQYADIIQFVRQALRRLPRLLLHVGTQPRGDDGISQDAVFVDVFGGVEGLHVFIVQTAYDHGNLAAQVHHFFQNAIHAAVFGKRGFEFVQRFDADLTFAVVAQRSRFQDAGQKLRACFSNVFGLANRLIRRGLQACFAYPRFFLNAVLCNGHAVAAGGNVGMLCQRAHRVGIDVFKFGRNRRAFCQFVQRGPVVKRRAQMAVGKFRRRRIRVGIENGYFVAHGFSGNGKHSA

SEQ ID NO: 40970 - DNA, 780 bp, Neisseria meningitidis
atggtgtccggaattgtgcgggcgcggggcgatttcgttgacgaccaattcatgcgtgtcaccgacaacaaacatttctaccgccaatacgccgacataatccaattcgtccgccaagcgttgcgccatctgccgcgcctgttgctgcacgtcggcactcagtcgcgcggggacgatggaataagccaagatgccgttttcgtggatgttttcggcagggtcgaaagtttgcacgttgtcattgttcaaacggcatacgattacggaaatttcactgcgcaaatccaccattttttccaaaacgcaatccacgccgccgtgttcggcaaacgcggctttgagttcatccaatgtttttacgcggatttgacctttgccgtcgtagcccaacgtagccgttttcaggatgccgggcaaaaattgcgcgcttgcttcagtgatgtcttcagccttacaaaccacttgatacggcgcggtttgcaatcccgctttgcgtatccatgccttttcctgaatgcggttttgtgcaatcgccacacaatcgccgctaggggaaacattggtatgttttgccaaaaagcgcatcgcatcggcattgacgttttcaaattcagtggtcaccgccgcgcattttgccaattcgtccaaagcagcttggtcgttaaacggcgcgcacaaatggcggtcggcaaattctgctgccggcgcgtccggatcggggtcgagaacggttactttgtagcccatggttttggcggcaacggtaaacattctgcctaa

SEQ ID NO: 40971 - protein, 259 aa, Neisseria meningitidis
MVSGIVRARGDFVDDQFMRVTDNKHFYRQYADIIQFVRQALRHLPRLLLHVGTQSRGDDGISQDAVFVDVFGRVESLHVVIVQTAYDYGNFTAQIHHFFQNAIHAAVFGKRGFEFIQCFYADLTFAVVAQRSRFQDAGQKLRACFSDVFSLTNHLIRRGLQSRFAYPCLFLNAVLCNRHTIAARGNIGMFCQKAHRIGIDVFKFSGHRRAFCQFVQSSLVVKRRAQMAVGKFCCRRVRIGVENGYFVAHGFGGNGKHSA

SEQ ID NO: 40972 - DNA, 780 bp, Neisseria meningitidis
atggtggccggaattgtgcggacgcggcgcgatttcgttgacgaccaattcatgcgtgtcgccgacaacaaacatttctaccgccaatacgccgacgtagttcaattcatcggccaaacgctgcgccatttgtcgcgcctgttgctgaatgtcggcactcagtcgggctgggacgatggagtaggcgaggataccgttttcgtgaatgttttcggcaggatcgaaagtttgcacgttgtcattgttcagacggcatacgataacggaaatttcgccgcgcaagtccaccattttttccaaaacgcaatccacgccgcggtgttcggcaaacgcggctttgagttcatccaccgttttgacgcggatttggcctttgccgtcatagcccaatgtagcggttttcaggatgccgggcagaaattgtatgctttcttcagtgatgtcttcggctttgcaaattgcttgatacggcgcggtttgcaggcctgctttgcgtatccatgccttttcctgaatgcggttttgcgcgatggcaacgcagtcgccgctgggggaaacattggtatgtttggcgagaaaacgcatcgcatcggcattgacgttttcgaactcggtcgtaacagccgcacattttgccaattcttccaaagcggtttggttgtcaaacggcgcacacaaatggcggtcggcaaattccgctgccggcgcattcgggttgggatcgagtacggttactttgtagcccatggttttggcagcaacagtaaacattctgcctaa

SEQ ID NO: 40973 - protein, 259 aa, Neisseria meningitidis
MVAGIVRTRRDFVDDQFMRVADNKHFYRQYADVVQFIGQTLRHLSRLLLNVGTQSGWDDGVGEDTVFVNVFGRIESLHVVIVQTAYDNGNFAAQVHHFFQNAIHAAVFGKRGFEFIHRFDADLAFAVIAQCSGFQDAGQKLYAFFSDVFGFANCLIRRGLQACFAYPCLFLNAVLRDGNAVAAGGNIGMFGEKTHRIGIDVFELGRNSRTFCQFFQSGLVVKRRTQMAVGKFRCRRIRVGIEYGYFVAHGFGSNSKHSA

SEQ ID NO: 40974 - DNA, 897 bp, Neisseria gonorrhoeae
atgcacatcggcggttattttatcgacaaccccatcgcacttgcgccgatggcgggcattgccgacaaacccttccgccgcctctgtcgggcgtttggcgcaggttgggcggtgtgcgaaatgctggccagcgatccgacgctcaggaataccggaaaaaccctgcaccgcagtgattttgccgatgaaggcggcatcgttgccgtgcagattgccggcagcgaccccgaacagatggcggatgcggcgcgttacaacgtcggactcggggcgcaggtcatcgacatcaatatgggctgccccgccaagaaagtgtgcaacgtccaagccggtagcgcgctgatgcaggacgagccgctggttgccgccattttggaggcggtggtcaaggcggcgggcgtacccgttaccctcaaaacccgtttgggttggcacgacgacgatcaaaacctgcccgccgtcgccaaaatcgccgaagattgcggcattgccgcccttgccgttccacgggcgcgcgcgcacgcaaatgtacaaaggcgaggcgcgttacgaactcatcgccgagaccaaaagccgtctgaacatcccggcctgggtcaacggcgacatcacttcgccgcaaaaagccgccgccgtcctcaaacaaaccgccgccgacggcatcatgatagggcgcggcgcgcaaggcaggccgtggtttttccgcgatttgaagcattatgccgaacacggcgttttaccgcctgccttgagtttggcagaatgcagagccgccattttgaaccacatccgcgccatgcacgcgttttatggtgagaccgtcggtgtgcgcatcgcacgcaaacacataggctggtacatcggcgaaatgcccgacggcgaacaggcgcggcgtga

SEQ ID NO: 40975 - protein, 298 aa, Neisseria gonorrhoeae
  misc_feature (272)..(272): Xaa can be any naturally occurring amino acid
MHIGGYFIDNPIALAPMAGIADKPFRRLCRAFGAGWAVCEMLASDPTLRNTGKTLHRSDFADEGGIVAVQIAGSDPEQMADAARYNVGLGAQVIDINMGCPAKKVCNVQAGSALMQDEPLVAAILEAVVKAAGVPVTLKTRLGWHDDDQNLPAVAKIAEDCGIAALAVPRARAHANVQRRGALRTHRRDQKPSEHPGLGQRRHHFAAKSRRRPQTNRRRRHHDRARRARQAVVFPRFEALCRTRRFTACLEFGRMQSRHFEPHPRHARVLWXDRRCAHRTQTHRLVHRRNARRRTGAA

SEQ ID NO: 40976 - DNA, 896 bp, Neisseria meningitidis
atgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaagccgtcgtccgtgcggcaggcgtacccgttaccctcaaaacccgtttgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaggccgtggttcttccgcgatttgaaacattatgccgaacacggtgttttgccgcctgccttgagtttggcagaatgcgccgccgctattttgaaccacatccgcgccatacacgcgttttacggcgacaccgccggtgtgcgcatcgcacgcaaacacataggctggtacatcgacgaaatgcccgacggcgaacagacacgtcgtga

SEQ ID NO: 40977 - protein, 298 aa, Neisseria meningitidis
  misc_feature (169)..(169): Xaa can be any naturally occurring amino acid
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVRAAGVPVTLKTRLGWHDDHQNLPVIAKIAEDCGIAALAVXRTHAYANVQRRSALRTHRRNQMPSEHPGLGQRRHYFAAKSPSRPQTNRRRRHYDRARRARQAVVLPRFETLCRTRCFAACLEFGRMRRRYFEPHPRHTRVLRRHRRCAHRTQTHRLVHRRNARRRTDTS

SEQ ID NO: 40978 - DNA, 896 bp, Neisseria meningitidis
atgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaggcggtggtcaaagcggcgggcgtacccgttaccctcaaaacccgtttgggttggcacgacgaccatcaaaacctgcccgtcatcgccaaaatcgccgaagattgcggcattgccgcccttgccgtccacggacgcacgcgcacgcaaatgtacaaaggcgaagcggcttacgacctgattgccgaaaccaaatgccgtctgaacatcccggtctgggtcaacggcgacattacctcgccgcaaaaagcccaagccgtcctcaaacaaaccgccgcagacggcattatgatagggcgcggcgcgcaaggcagaccgtggttcttccgcgatttgaaacattacgccgaacacggtgttttaccgcctgccttgagtttggcagaatgtaccgccactattttgaaccacatccgagccatgcacgcgttttacggcgacaccgccggtgtgcgcatcgcacgcaaacacataggctggtacatcgacgaaatgcccgacggcgaacagacacgtcgtga

SEQ ID NO: 40979 - protein, 298 aa, Neisseria meningitidis
  misc_feature (168)..(168): Xaa can be any naturally occurring amino acid
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVKAAGVPVTLKTRLGWHDDHQNLPVIAKIAEDCGIAALAXPRTHAHANVQRRSGLRPDCRNQMPSEHPGLGQRRHYLAAKSPSRPQTNRRRRHYDRARRARQTVVLPRFETLRRTRCFTACLEFGRMYRHYFEPHPSHARVLRRHRRCAHRTQTHRLVHRRNARRRTDTS

SEQ ID NO: 40980 - DNA, 882 bp, Neisseria gonorrhoeae
atgtgtaccgagatgaaatttatattttttgtactgtatgttttgcagtttctgccgtttgcgctgctgcacaagattgccggcctgatcggttcgcttgcctaccttctggtcaaaccgcgccgccgtatcggcgaaatcaatttggcaaaatgttttcccgaatgggacgaagaaaagcgtaaaaccgtgttgaaacagcatttcaaacacatggcaaaactgatgctcgaatacggcttatattggtacgcgtctgccaaatgcctgaaatcgctggtgcgctaccgcaataagcattatttggacgacgcgctggcggcgggggaaaaagtcatcatcctgtacccgcactttaccgcgttcgagatggcggtgtacgcgcttaatcaggatgtcccgctgatcagtatgtattcccaccaaaaaaacaagatattggacgaacagattttgaaaggccgcaaccgctatcacaacgtcttccttatcgggcgcaccgaagggctgcgcgccctcgtcaaacagttccgcaaaagcagtgcgccgttcctgtatctgcccgatcaggatttcggacgcaacaattcggtttttgtggattttttcggcattcagacggcaacgattaccggcttgagccgcattgccgcgcttgcaaatgcaaaagtgatacccgccattcccgtccgcgaggcggacaatacggttacattgcaattctatcccgcttggaaatcctttccgagtgaagacgcgcaagccgacgcgcaacgtatgaaccgctttatcgaagaacgcgtgcgcgaacacccggaacaatatttctggctgcacaagcgtttcaaaacccgtccggaaggcagccccgatttttactga

SEQ ID NO: 40981 - protein, 293 aa, Neisseria gonorrhoeae
MCTEMKFIFFVLYVLQFLPFALLHKIAGLIGSLAYLLVKPRRRIGEINLAKCFPEWDEEKRKTVLKQHFKHMAKLMLEYGLYWYASAKCLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNNSVFVDFFGIQTATITGLSRIAALANAKVIPAIPVREADNTVTLQFYPAWKSFPSEDAQADAQRMNRFIEERVREHPEQYFWLHKRFKTRPEGSPDFY

SEQ ID NO: 40982 - DNA, 882 bp, Neisseria meningitidis
atgtgtatcgagatgaaatttatattttttgtactgtatgttttgcagtttctgccgtttgcgctgctgcacaagattgccgacctgacgggtttgcttgcctaccttctggtcaaaccgcgccgccgtatcggcgaaatcaatttggcaaaatgtttttccgaatggagtgaggaaaagcgtaaaaccgtgttgaaacagcatttcaaacacatggcgaaactgatgttggaatacggtttatattggtacgcgcctgccggacgtttgaaatcgctggtgcgctaccgcaataagcattatttggacgacgcgctggcggcgggggaaaaagtcatcatcctgtatccgcacttcaccgcgttcgagatggcggtgtacgcgcttaatcaggatatcccgctgatcagtatgtattcccatcaaaaaaacaagatattggacgaacagattttgaaaggccgcaaccgctatcacaacgtcttccttatcgggcgcaccgaagggctgcgcgccctcgtcaaacagttccgcaaaagcagcgcgccgtttctgtatctgcccgatcaggatttcggacgcaacgattcggtttttgtggattttttcggtattcagacggcaacgattaccggattgagccgcattgccgcgcttgcaaatgcaaaagtgatacccgccattcccgtccgcgaggcagacaatacggttacattgcatttctaccctgcttggaaatcctttccgggtgaagacgcgaaagccgacgcgcagcgcatgaaccgttttatcgaagacagggtgcgcgaacatccggaacaatatttttggctgcacaagcgttttaaaacccgtccggaaggcagccccgatttttactga

SEQ ID NO: 40983 - protein, 293 aa, Neisseria meningitidis
MCIEMKFIFFVLYVLQFLPFALLHKIADLTGLLAYLLVKPRRRIGEINLAKCFSEWSEEKRKTVLKQHFKHMAKLMLEYGLYWYAPAGRLKSLVRYRNKHYLDDALAAGEKVIILYPHFTAFEMAVYALNQDIPLISMYSHQKNKILDEQILKGRNRYHNVFLIGRTEGLRALVKQFRKSSAPFLYLPDQDFGRNDSVFVDFFGIQTATITGLSRIAALANAKVIPAIPVREADNTVTLHFYPAWKSFPGEDAKADAQRMNRFIEDRVREHPEQYFWLHKRFKTRPEGSPDFY

SEQ ID NO: 40984 - DNA, 882 bp, Neisseria meningitidis
atgtgtatcgagatgaaatttatattttttgtactgtatgttttgcagtttctgccgtttgcgctgctgcacaaacttgctgatctgacaggcttgctcgcctaccttttggtcaaaccccgccgccgtatcggcgaaatcaatttggcaaaatgctttcccgagtgggacggaaaaaagcgtaaaaccgtgttgaaacagcatttcaaacatatggcgaaactgatgttggaatacggtttatattggtacgcgcccgccgggcgtttgaaatcactggtgcgctaccgcaacaaacattatttggacgacgctctggcggcaggggaaaaagtcatcatcctgtatccgcacttcaccgcgttcgagatggcggtgtacgcgctcaatcaggatgttccgctgatcagtatgtattcccaccaaaaaaacaagatattggacgaacagattttgaaaggccgcaaccgctatcacaacgttttccttatcgggcgcaccgaagggctgcgcgccctcgtcaaacagttccgcaaaagcagcgcgccgtttctgtatctgcccgatcaggatttcggacgcaacgattcggtttttgtcgatttcttcggtattcggacggcaacgattaccggcttgagccgcattgccgcgcttgcaaatgcaaaagtgatacccgccatccctgtccgcgaggcggacaatacggttacattgcatttctaccctgcttgggaatcctttccgagtgaagatgcgcaggccgacgcgcagcgcatgaaccgttttatcgaggaacgcgtgcgcgaacatcccgagcagtatttttggctgcacaagcgtttcaaaacccgtccggaaggcagccccgatttttactga

SEQ ID NO: 40985 - protein, 293 aa, Neisseria meningitidis
MCIEMKFIFFVLYVLQFLPFALLHKLADLTGLLAYLLVKPRRRIGEINLAKCFPEWDGKKRKTVLKQHFKHMAKLMLEYGLYWYAPAGRLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNDSVFVDFFGIRTATITGLSRIAALANAKVIPAIPVREADNTVTLHFYPAWESFPSEDAQADAQRMNRFIEERVREHPEQYFWLHKRFKTRPEGSPDFY

SEQ ID NO: 40986 - DNA, 552 bp, Neisseria gonorrhoeae
atgatacatccgcaccacttccgcgcctttttcataaacggtcatggtgtagaaattgttcatctcctcatagctgacggggcgcaccggatgggcggtcgggcctgcgtcttcggggaactggttctggcgcagcaggcggatgttctcgatgcggcgcacggcgcggccggcgcggtcgccggaaaactcttggtcgcggaacacggtcagcccttccttcagcgaaagctggaaccagtcgcggcaggttacgcggttgcccgtccagttgtggaaatattcgtgtccgaccacggattcaatgccttcgaaatcggtatcggtggcggtgcggctgtcggcgaggacgaacttggtgttaaaaatgttcaaacccttgttttccatcgcgcccatattgaaatcgcctacggcgacgaccatgaaaatatccaagtcatattccaacccgaagcgcgtttcgtcccacttcatcgcgttttttcaacgattccacggcaaagccgaccttgggtttgtccgcttcggtggtgtaaaactcgattttga

SEQ ID NO: 40987 - protein, 183 aa, Neisseria gonorrhoeae
MIHPHHFRAFFINGHGVEIVHLLIADGAHRMGGRACVFGELVLAQQADVLDAAHGAAGAVAGKLLVAEHGQPFLQRKLEPVAAGYAVARPVVEIFVSDHGFNAFEIGIGGGAAVGEDELGVKNVQTLVFHRAHIEIAYGDDHENIQVIFQPEARFVPLHRVFSTIPRQSRPWVCPLRWCKTRF

SEQ ID NO: 40988 - DNA, 551 bp, Neisseria meningitidis
gtgatacatccgcactacttccgcgcctttttcataaacggtcatggtgtagaaattgttcatctcctcatagctggcggggcgcaccggatgggcggtcgggcctgcgtcttcggggaactggtgctggcgcagcaggcggatgttttcgatgcggcgcacggcgcggctggcgcggtcgccggaaaattcttggtcgcggaacacggtcagcccttccttcagcgaaagctggaaccagtcgcggcaggttacgcggttgcccgtccagttgtggaaatactcgtgtccgaccacggattcgatgccttcgaaatcggtatcggtggcggtgcggctgtcggcaaggacgaacttggtgttaaagatgttcaaacccttgttttccatcgcgcccatattgaaatcgcccacggcgacgaccatgaaaatatccaagtcgtattccaaaccgaagcgcgtttcgtcccatttcatcgcgtttttcaacgattccacggcaaagccgaccttgggcttgtccgcttcggtggtgtaaaactcgattttga

SEQ ID NO: 40989 - protein, 183 aa, Neisseria meningitidis
  misc_feature (163)..(163): Xaa can be any naturally occurring amino acid
VIHPHYFRAFFINGHGVEIVHLLIAGGAHRMGGRACVFGELVLAQQADVFDAAHGAAGAVAGKFLVAEHGQPFLQRKLEPVAAGYAVARPVVEILVSDHGFDAFEIGIGGGAAVGKDELGVKDVQTLVFHRAHIEIAHGDDHENIQVVFQTEARFVPFHRVFXTIPRQSRPWACPLRWCKTRF

SEQ ID NO: 40990 - DNA, 551 bp, Neisseria meningitidis
gtgatacatccgcaccacttccgcgcctttttcataaacggtcatggtgtagaaattgttcatctcctcatatcgggcggggcgcaccggatgtgcggtcggacctgcgtcttcggggaactggtgctggcgcagcaggcggatgttttcgatacggcgcacggcgcggctggcgcggtcgccggaaaattcttggtcgcggaacacggtcaacccttccttcagcgaaagctggaaccagtcgcggcaggtcacgcggttgcccgtccagttgtggaaatattcgtgtccgaccacggattcgatgccttcaaaatcggtatcggtggcggtacggctgtcggcaaggacgaacttggtgttaaagatgttcaaacccttgttttccatcgcacccatattgaaatcgcccacggcgacgaccatgaaaatatccaagtcgtattccaaaccgaagcgcgtttcgtcccacttcattgcgtttttcagcgattccacggcaaagccgaccttgggcttgtccgcttcggtggtgtaaaactcgattttga

SEQ ID NO: 40991 - protein, 183 aa, Neisseria meningitidis
  misc_feature (163)..(163): Xaa can be any naturally occurring amino acid
VIHPHHFRAFFINGHGVEIVHLLISGGAHRMCGRTCVFGELVLAQQADVFDTAHGAAGAVAGKFLVAEHGQPFLQRKLEPVAAGHAVARPVVEIFVSDHGFDAFKIGIGGGTAVGKDELGVKDVQTLVFHRTHIEIAHGDDHENIQVVFQTEARFVPLHCVFXAIPRQSRPWACPLRWCKTRF

SEQ ID NO: 40992 - DNA, 1917 bp, Neisseria gonorrhoeae
atgaagtgggacgaaacgcgcttcgggttggaatatgacttggatattttcatggtcgtcgccgtaggcgatttcaatatgggcgcgatggaaaacaagggtttgaacatttttaacaccaagttcgtcctcgccgacagccgcaccgccaccgataccgatttcgaaggcattgaatccgtggtcggacacgaatatttccacaactggacgggcaaccgcgtaacctgccgcgactggttccagctttcgctgaaggaagggctgaccgtgttccgcgaccaagagttttccggcgaccgcgccggccgcgccgtgcgccgcatcgagaacatccgcctgctgcgccagaaccagttccccgaagacgcaggcccgaccgcccatccggtgcgccccgtcagctatgaggagatgaacaatttctacaccatgaccgtttatgaaaaaggcgcggaagtggtgcggatgtatcataccctgctcggcgaagagggcttccaaaaaggcatgaagctatatttccaacgccacgacggacaggcagtgacctgcgacgatttccgcgcggcgatggcggatgcgaacggcatcaatctcgaccagttcgccttgtggtacagccaggcgggcacgcccgttttggaagccgaaggccgtctgaaaaacaatgttttcgagttaaccattaaacaaaccgtgccgcccacgcccgatatggcggacaaacagccgatgatgattcccgtcaaagtcgggcttctgaaccgcaacggcgaagcggtggcattcgattatcagggcaaacgcgcaaccgaagccgtgttgctgatgaccgaagccgaacaggccttcccgctcgaaggtgtaaccgaagccgtcgttccctcgctgctgcgcgggttcagcgcgccagtgtatctgaactatccgtacagcgacgacgacctgctgctcctgctcgcccacgacagcgacgctttcacgtgctgggaagccgcccaaacgctctaccgtcgcgccgtcgccgccaaccttgccgcgctttcagacggcatcgggttgccgaaacacgaaaaactgcttgccgccgtcgaaaaagtcatttcagacgacctcttggacaacgccttcaaagccctgcttttgggcgtgccgtccgaagccgaactgtgggacggcacggaaaacatcgacccgctgcgctaccatcaggcgcgcgaagccttgttggatacgcttgccgtccgcttcctgccgaaatggcacgaattggaccgtcaggcggcgaagcaggaaaaccaaagttacgaatacagccccgaaaccgccgactggcgcacgctgcgcaacgtctgccgcgccttcgtcctgcgcgccgaccccgcgcacatcgaaactgttgccgaaaaatacggcgaaatggcgcaaaacatgacccacgaatggggcatcctgtccgccgtcaacggcaacgaaagcgatacgcgcaactgcctgctggcgcagtttgccgacaagttttcagacgacgcgctggtgatggacaaatatttcgcccttatcggctcaagccgccgcagcgacaccctgcaacaggttcaaaccgccttgcagcatccgaaattcagtctcgaaaaccccaacaaagcccgttcgctcatcggcagcttcagccgcaacgtcccgcattttcacgcacaagacggcagcggctaccgcttcatcgccgacaaagtcatcgaaatcgaccgcttcaacccgcaggtcgccgcccgcctggtgcaggcgttcaacctctgcaacaagctcgagccgcaccgcaaaaacttggtgaaacaagaattgcagtgcattcgggcgcaggaaggattgtcgaaagacgtgggcgaaatcgtcggcaagattttgggttga

SEQ ID NO: 40993 - protein, 638 aa, Neisseria gonorrhoeae
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRAGRAVRRIENIRLLRQNQFPEDAGPTAHPVRPVSYEEMNNFYTMTVYEKGAEVVRMYHTLLGEEGFQKGMKLYFQRHDGQAVTCDDFRAAMADANGINLDQFALWYSQAGTPVLEAEGRLKNNVFELTIKQTVPPTPDMADKQPMMIPVKVGLLNRNGEAVAFDYQGKRATEAVLLMTEAEQAFPLEGVTEAVVPSLLRGFSAPVYLNYPYSDDDLLLLLAHDSDAFTCWEAAQTLYRRAVAANLAALSDGIGLPKHEKLLAAVEKVISDDLLDNAFKALLLGVPSEAELWDGTENIDPLRYHQAREALLDTLAVRFLPKWHELDRQAAKQENQSYEYSPETADWRTLRNVCRAFVLRADPAHIETVAEKYGEMAQNMTHEWGILSAVNGNESDTRNCLLAQFADKFSDDALVMDKYFALIGSSRRSDTLQQVQTALQHPKFSLENPNKARSLIGSFSRNVPHFHAQDGSGYRFIADKVIEIDRFNPQVAARLVQAFNLCNKLEPHRKNLVKQELQCIRAQEGLSKDVGEIVGKILG

SEQ ID NO: 40994 - DNA, 1917 bp, Neisseria meningitidis
atgaaatgggacgaaacgcgcttcggtttggaatacgacttggatattttcatggtcgtcgccgtgggcgatttcaatatgggcgcgatggaaaacaagggtttgaacatctttaacaccaagttcgtccttgccgacagccgcaccgccaccgataccgatttcgaaggcatcgaatccgtggtcggacacgagtatttccacaactggacgggcaaccgcgtaacctgccgcgactggttccagctttcgctgaaggaagggctgaccgtgttccgcgaccaagaattttccggcgaccgcgccagccgcgccgtgcgccgcatcgaaaacatccgcctgctgcgccagcaccagttccccgaagacgcaggcccgaccgcccatccggtgcgccccgccagctatgaggagatgaacaatttctacaccatgaccgtttatgaaaaaggcgcggaagtagtgcggatgtatcacaccctgctcggcgaagagggcttccagaaaggcatgaagctctatttccaacgccacgacggacaggccgttacctgcgacgatttccgcgcggcgatggcggacgcgaacggcatcaatctcgaccagttcgccttgtggtacagccaggcgggcacgcccgttttggaagcggaaggtcgtctgaaaaacaatattttcgagttgaccgtcaaacaaaccgtgccgcccacgcccgatatgacggataaacagccgatgatgattcccgtcaaggtcgggctgctgaaccgcaacggcgaagcggtggcattcgactatcagggcaaacgcgcgaccgaagccgtgttgctgctgaccgaagccgaacagaccttcctgctcgaaggcgtaaccgaagccgtcgttccctcgctgctgcgcgggttcagcgcgccggtgcatctgaactatccgtacagcgacgacgacctgctgctcctgctcgcccatgacagcgacgccttcacgcgctgggaagccgcccaaacgctctaccgccgcgccgtcgccgccaaccttgccacgctttcagacggcgttgagctgccgaaacacgaaaaactgcttgccgccgtcgaaaaagtcatttcagacgacctcttagacaacgccttcaaagccctgcttttgggcgtgccatccgaagccgagctgtgggacggcgcagaaaacatcgacccgctgcgctaccatcaggcgcgcgaagccttgttggatacgcttgccgtccacttcctgccgaaatggcacgaattgaaccgtcaggcggcgaagcaggaaaaccaaagctacgaatacagccccgaagccgccggctggcgcacgctgcgcaacgtctgccgcgcctttgtcctgcgcgccgaccccgcgcacatcgaaaccgttgccgaaaaatacggcgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatattttgccctcgtcggctcaagccgccgcagcgacaccctgcaacaggttcgaaccgccttgcagcatccgaaattcagcctcgaaaaccccaacaaagcccgttcgctcatcggcagcttcagccgcaacgtcccgcatttccacgcagaagacggcagcggctaccgcttcatcgccgacaaagtcatcgaaatcgaccgcttcaacccgcaggtcgccgcccgcttagtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 40995 - protein, 638 aa, Neisseria meningitidis
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPASYEEMNNFYTMTVYEKGAEVVRMYHTLLGEEGFQKGMKLYFQRHDGQAVTCDDFRAAMADANGINLDQFALWYSQAGTPVLEAEGRLKNNIFELTVKQTVPPTPDMTDKQPMMIPVKVGLLNRNGEAVAFDYQGKRATEAVLLLTEAEQTFLLEGVTEAVVPSLLRGFSAPVHLNYPYSDDDLLLLLAHDSDAFTRWEAAQTLYRRAVAANLATLSDGVELPKHEKLLAAVEKVISDDLLDNAFKALLLGVPSEAELWDGAENIDPLRYHQAREALLDTLAVHFLPKWHELNRQAAKQENQSYEYSPEAAGWRTLRNVCRAFVLRADPAHIETVAEKYGEMAQNMTHEWGILSAVNGNESDTRNRLLAQFADKFSDDALVMDKYFALVGSSRRSDTLQQVRTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 40996 - DNA, 1917 bp, Neisseria meningitidis
atgaagtgggacgaaacgcgcttcggtttggaatacgacttggatattttcatggtcgtcgccgtgggcgatttcaatatgggtgcgatggaaaacaagggtttgaacatctttaacaccaagttcgtccttgccgacagccgtaccgccaccgataccgattttgaaggcatcgaatccgtggtcggacacgaatatttccacaactggacgggcaaccgcgtgacctgccgcgactggttccagctttcgctgaaggaagggttgaccgtgttccgcgaccaagaattttccggcgaccgcgccagccgcgccgtgcgccgtatcgaaaacatccgcctgctgcgccagcaccagttccccgaagacgcaggtccgaccgcacatccggtgcgccccgcccgatatgaggagatgaacaatttctacaccatgaccgtttatgaaaaaggcgcggaagtggtgcggatgtatcacaccttgctcggcgaagagggcttccaaaaaggtatgaagctctatttccaacgccacgacggacaggctgttacctgcgacgatttccgcgcggcgatggtggacgcgaacggcatcaacctcgaccaattcgccttgtggtacagccaagcaggtacgccggttttagatgctcaagggcgtctgaaaaacaatgtgttcgagttaaccatcaaacaaaccgtgccgcccacgcccgatatggcggacaaacagccgatgatgattcccgtcaaaatcgggctgctgaactgcaacggcgaagcggtggcatttgattatcagggcaaacgcgcgaccgaagccgtgttgctgctgaccgaagccgaacagaccttccagttcgaaagcgtaaccgaagccgtcgttccctcgctgctgcgcgggttcagcgcgccggtgcatctgaactatccgtacagcgacgacgacctgctgcttctgctcgcccatgacagcgacgccttcacgcgctgggaagccgcacaaacgctctaccgccgtgccgtcgccgccaaccttgccgcgctttcagacggcgtcgagttgccgaaacacgaaaaactgcttgccgccgtcgaaaaagtcatttcagacgacctcttagacaacgctttcaaagccctgcttttgggtgtgccgtctgaagccgagctgtgggacggcgcggaaaacatcgacccgctgcgctaccatcaggcgcgcgaagccttgttggatatacttgccgtccgctttctgccgaaatggcacgaattgaaccgtcaggcggcgaagcaggaaaaccaaagctacgagtacagccccgaagccgccggttggcgcacgctgcgcaatgtctgccgcgccttcgtcctgcgcgccgatcccgcgcacatcgaaaccgttgccgagaaatacgccgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatatttcgccctcgtcggctcaagccgccgcagcgacaccctgcaacaggttcaaaccgccttgcagcatccgaagttcagcctcgaaaatcccaacaaagcccgctcgctcatcggcagcttcagccgcaacgtcccgcatttccacgcagaagacggcagcggctaccgcttcatcgccgacaaagtcatcgaaatcgaccgctttaacccgcaggtcgccgcccgcctggtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 40997 - protein, 638 aa, Neisseria meningitidis
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPARYEEMNNFYTMTVYEKGAEVVRMYHTLLGEEGFQKGMKLYFQRHDGQAVTCDDFRAAMVDANGINLDQFALWYSQAGTPVLDAQGRLKNNVFELTIKQTVPPTPDMADKQPMMIPVKIGLLNCNGEAVAFDYQGKRATEAVLLLTEAEQTFQFESVTEAVVPSLLRGFSAPVHLNYPYSDDDLLLLLAHDSDAFTRWEAAQTLYRRAVAANLAALSDGVELPKHEKLLAAVEKVISDDLLDNAFKALLLGVPSEAELWDGAENIDPLRYHQAREALLDILAVRFLPKWHELNRQAAKQENQSYEYSPEAAGWRTLRNVCRAFVLRADPAHIETVAEKYAEMAQNMTHEWGILSAVNGNESDTRNRLLAQFADKFSDDALVMDKYFALVGSSRRSDTLQQVQTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 40998 - DNA, 2604 bp, Neisseria gonorrhoeae
atgagcaaaaccgtccgttatctgaaagattaccaaacgcctgcctaccgcattcttgaaaccgaactgcatttcgacattgccgaaccgcaaaccgtcgtgaagtcgcgtttgacggtcgagccgcagagggcgggcgagccgctggtgttggacggttcggcaaaactcttgtccgtcaaaatcaacggcgcggcggcggattatgtgttggaaggcgagacgctgacgattgcagacgtaccgtccgaacgcttcaccgtcgaagtggaaaccgaaatcctgccggcggaaaacaaatcgctgatggggctgtatgcttccggcggcaatctgtttacccagtgcgagccggagggcttccgcaaaatcacgttctacatcgaccgtccggatgtgatgtccaagttcacgaccaccatcgtcgcggacaaaaaacgctatcccgttttgctttccaacggcaacaaaatcgacggcggcgagttttcagacggccgccattgggtgaaatgggaagacccgtttgccaaaccgagttatctgtttgctttggtcgcgggcgatttggcggtaacggaagaccgtttcaccaccatgagcggcagaaacgtcaaaatcgagttttacaccaccgaagcggacaaacccaaggtcggctttgccgtggaatcgttgaaaaacgcgatgaagtgggacgaaacgcgcttcgggttggaatatgacttggatattttcatggtcgtcgccgtaggcgatttcaatatgggcgcgatggaaaacaagggtttgaacatttttaacaccaagttcgtcctcgccgacagccgcaccgccaccgataccgatttcgaaggcattgaatccgtggtcggacacgaatatttccacaactggacgggcaaccgcgtaacctgccgcgactggttccagctttcgctgaaggaagggctgaccgtgttccgcgaccaagagttttccggcgaccgcgccggccgcgccgtgcgccgcatcgagaacatccgcctgctgcgccagaaccagttccccgaagacgcaggcccgaccgcccatccggtgcgccccgtcagctatgaggagatgaacaatttctacaccatgaccgtttatgaaaaaggcgcggaagtggtgcggatgtatcataccctgctcggcgaagagggcttccaaaaaggcatgaagctatatttccaacgccacgacggacaggcagtgacctgcgacgatttccgcgcggcgatggcggatgcgaacggcatcaatctcgaccagttcgccttgtggtacagccaggcgggcacgcccgttttggaagccgaaggccgtctgaaaaacaatgttttcgagttaaccattaaacaaaccgtgccgcccacgcccgatatggcggacaaacagccgatgatgattcccgtcaaagtcgggcttctgaaccgcaacggcgaagcggtggcattcgattatcagggcaaacgcgcaaccgaagccgtgttgctgatgaccgaagccgaacaggccttcccgctcgaaggtgtaaccgaagccgtcgttccctcgctgctgcgcgggttcagcgcgccagtgtatctgaactatccgtacagcgacgacgacctgctgctcctgctcgcccacgacagcgacgctttcacgtgctgggaagccgcccaaacgctctaccgtcgcgccgtcgccgccaaccttgccgcgctttcagacggcatcgggttgccgaaacacgaaaaactgcttgccgccgtcgaaaaagtcatttcagacgacctcttggacaacgccttcaaagccctgcttttgggcgtgccgtccgaagccgaactgtgggacggcacggaaaacatcgacccgctgcgctaccatcaggcgcgcgaagccttgttggatacgcttgccgtccgcttcctgccgaaatggcacgaattggaccgtcaggcggcgaagcaggaaaaccaaagttacgaatacagccccgaaaccgccgactggcgcacgctgcgcaacgtctgccgcgccttcgtcctgcgcgccgaccccgcgcacatcgaaactgttgccgaaaaatacggcgaaatggcgcaaaacatgacccacgaatggggcatcctgtccgccgtcaacggcaacgaaagcgatacgcgcaactgcctgctggcgcagtttgccgacaagttttcagacgacgcgctggtgatggacaaatatttcgcccttatcggctcaagccgccgcagcgacaccctgcaacaggttcaaaccgccttgcagcatccgaaattcagtctcgaaaaccccaacaaagcccgttcgctcatcggcagcttcagccgcaacgtcccgcattttcacgcacaagacggcagcggctaccgcttcatcgccgacaaagtcatcgaaatcgaccgcttcaacccgcaggtcgccgcccgcctggtgcaggcgttcaacctctgcaacaagctcgagccgcaccgcaaaaacttggtgaaacaagaattgcagtgcattcgggcgcaggaaggattgtcgaaagacgtgggcgaaatcgtcggcaagattttgggttga

SEQ ID NO: 40999 - protein, 867 aa, Neisseria gonorrhoeae
MSKTVRYLKDYQTPAYRILETELHFDIAEPQTVVKSRLTVEPQRAGEPLVLDGSAKLLSVKINGAAADYVLEGETLTIADVPSERFTVEVETEILPAENKSLMGLYASGGNLFTQCEPEGFRKITFYIDRPDVMSKFTTTIVADKKRYPVLLSNGNKIDGGEFSDGRHWVKWEDPFAKPSYLFALVAGDLAVTEDRFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRAGRAVRRIENIRLLRQNQFPEDAGPTAHPVRPVSYEEMNNFYTMTVYEKGAEVVRMYHTLLGEEGFQKGMKLYFQRHDGQAVTCDDFRAAMADANGINLDQFALWYSQAGTPVLEAEGRLKNNVFELTIKQTVPPTPDMADKQPMMIPVKVGLLNRNGEAVAFDYQGKRATEAVLLMTEAEQAFPLEGVTEAVVPSLLRGFSAPVYLNYPYSDDDLLLLLAHDSDAFTCWEAAQTLYRRAVAANLAALSDGIGLPKHEKLLAAVEKVISDDLLDNAFKALLLGVPSEAELWDGTENIDPLRYHQAREALLDTLAVRFLPKWHELDRQAAKQENQSYEYSPETADWRTLRNVCRAFVLRADPAHIETVAEKYGEMAQNMTHEWGILSAVNGNESDTRNCLLAQFADKFSDDALVMDKYFALIGSSRRSDTLQQVQTALQHPKFSLENPNKARSLIGSFSRNVPHFHAQDGSGYRFIADKVIEIDRFNPQVAARLVQAFNLCNKLEPHRKNLVKQELQCIRAQEGLSKDVGEIVGKILG

SEQ ID NO: 41000 - DNA, 2604 bp, Neisseria meningitidis
atgagcaaaaccgtgcattatctcaaagactatcaaacgcccgcctaccatattctcaaaaccgatttacattttgatattaatgaaccgcaaaccgtcgtgaagtcgcgtttgacggttgagccgcagagggtaggggagccgctggtgttggacggttcggcgaaactcttgtccgtcaaaatcaacggggcggcggcggattatgtgttggaaggagagacgctgacgattgcgggcgtgccgtccgaacgcttcaccgtcgaagtggaaaccgaaatcctgccggcggaaaacaaatcgctgatggggctgtatgcttccggcggcaatttgtttacccagtgcgagccggagggcttccgcaaaatcacattttacatcgaccgtccggatgtgatgtccaagttcaccaccaccatcgtcgccgacaaaaaacgctatcccgttttgctttccaacggcaacaaaatcgacggcggcgagttttcagacggccgccattgggtgaaatgggaagacccgttttccaaaccgagctatctgtttgctttggtcgcgggcgatttggcggtaacggaagactatttcaccaccatgagcggcagaaacgtcaaaatcgagttttacaccaccgaagcggacaagcccaaggtcggctttgccgtggaatcgttgaaaaacgcgatgaaatgggacgaaacgcgcttcggtttggaatacgacttggatattttcatggtcgtcgccgtgggcgatttcaatatgggcgcgatggaaaacaagggtttgaacatctttaacaccaagttcgtccttgccgacagccgcaccgccaccgataccgatttcgaaggcatcgaatccgtggtcggacacgagtatttccacaactggacgggcaaccgcgtaacctgccgcgactggttccagctttcgctgaaggaagggctgaccgtgttccgcgaccaagaattttccggcgaccgcgccagccgcgccgtgcgccgcatcgaaaacatccgcctgctgcgccagcaccagttccccgaagacgcaggcccgaccgcccatccggtgcgccccgccagctatgaggagatgaacaatttctacaccatgaccgtttatgaaaaaggcgcggaagtagtgcggatgtatcacaccctgctcggcgaagagggcttccagaaaggcatgaagctctatttccaacgccacgacggacaggccgttacctgcgacgatttccgcgcggcgatggcggacgcgaacggcatcaatctcgaccagttcgccttgtggtacagccaggcgggcacgcccgttttggaagcggaaggtcgtctgaaaaacaatattttcgagttgaccgtcaaacaaaccgtgccgcccacgcccgatatgacggataaacagccgatgatgattcccgtcaaggtcgggctgctgaaccgcaacggcgaagcggtggcattcgactatcagggcaaacgcgcgaccgaagccgtgttgctgctgaccgaagccgaacagaccttcctgctcgaaggcgtaaccgaagccgtcgttccctcgctgctgcgcgggttcagcgcgccggtgcatctgaactatccgtacagcgacgacgacctgctgctcctgctcgcccatgacagcgacgccttcacgcgctgggaagccgcccaaacgctctaccgccgcgccgtcgccgccaaccttgccacgctttcagacggcgttgagctgccgaaacacgaaaaactgcttgccgccgtcgaaaaagtcatttcagacgacctcttagacaacgccttcaaagccctgcttttgggcgtgccatccgaagccgagctgtgggacggcgcagaaaacatcgacccgctgcgctaccatcaggcgcgcgaagccttgttggatacgcttgccgtccacttcctgccgaaatggcacgaattgaaccgtcaggcggcgaagcaggaaaaccaaagctacgaatacagccccgaagccgccggctggcgcacgctgcgcaacgtctgccgcgcctttgtcctgcgcgccgaccccgcgcacatcgaaaccgttgccgaaaaatacggcgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatattttgccctcgtcggctcaagccgccgcagcgacaccctgcaacaggttcgaaccgccttgcagcatccgaaattcagcctcgaaaaccccaacaaagcccgttcgctcatcggcagcttcagccgcaacgtcccgcatttccacgcagaagacggcagcggctaccgcttcatcgccgacaaagtcatcgaaatcgaccgcttcaacccgcaggtcgccgcccgcttagtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 41001 - protein, 867 aa, Neisseria meningitidis
MSKTVHYLKDYQTPAYHILKTDLHFDINEPQTVVKSRLTVEPQRVGEPLVLDGSAKLLSVKINGAAADYVLEGETLTIAGVPSERFTVEVETEILPAENKSLMGLYASGGNLFTQCEPEGFRKITFYIDRPDVMSKFTTTIVADKKRYPVLLSNGNKIDGGEFSDGRHWVKWEDPFSKPSYLFALVAGDLAVTEDYFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPASYEEMNNFYTMTVYEKGAEVVRMYHTLLGEEGFQKGMKLYFQRHDGQAVTCDDFRAAMADANGINLDQFALWYSQAGTPVLEAEGRLKNNIFELTVKQTVPPTPDMTDKQPMMIPVKVGLLNRNGEAVAFDYQGKRATEAVLLLTEAEQTFLLEGVTEAVVPSLLRGFSAPVHLNYPYSDDDLLLLLAHDSDAFTRWEAAQTLYRRAVAANLATLSDGVELPKHEKLLAAVEKVISDDLLDNAFKALLLGVPSEAELWDGAENIDPLRYHQAREALLDTLAVHFLPKWHELNRQAAKQENQSYEYSPEAAGWRTLRNVCRAFVLRADPAHIETVAEKYGEMAQNMTHEWGILSAVNGNESDTRNRLLAQFADKFSDDALVMDKYFALVGSSRRSDTLQQVRTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 41002 - DNA, 2604 bp, Neisseria meningitidis
atgagcaaaaccgtgcattatctcaaagactatcaaacgcccgcctaccatattctcaaaaccgatttacattttgatattaacgaaccgcaaaccattgtgaagtcgcgtttgacggtcgagccgaagagggtgggagagccgctggtgttggacggttcggcgaaactcttgtccgtcaaaatcaacggcgtggcggcggattatgtgttggaaggcgagacgctgacgattgcggacgtgccgtccgaacgcttcaccgtcgaagtggaaaccgaaatcctgccggcggaaaacaaatcgctgatggggctgtatgcgtccgccggtaacctgtttacccagtgcgagccggagggcttccgcaaaatcacgttctatatcgaccgtccggatgtcatgtccaagttcacgaccaccatcgtcgcggacaaaaaacgctatcccgttttgctctccaacggcaacaaaatcgacggcggcgagtattcagacggccgccattgggtgaaatgggaagacccgtttgccaaaccgagttatctgtttgctttggtcgcgggcgatttggcggtcacggaagactatttcaccaccatgagcggcagaaacgtcaaaatcgagttttacaccaccgaagcggacaagcccaaggtcggctttgccgtggaatcgctgaaaaacgcaatgaagtgggacgaaacgcgcttcggtttggaatacgacttggatattttcatggtcgtcgccgtgggcgatttcaatatgggtgcgatggaaaacaagggtttgaacatctttaacaccaagttcgtccttgccgacagccgtaccgccaccgataccgattttgaaggcatcgaatccgtggtcggacacgaatatttccacaactggacgggcaaccgcgtgacctgccgcgactggttccagctttcgctgaaggaagggttgaccgtgttccgcgaccaagaattttccggcgaccgcgccagccgcgccgtgcgccgtatcgaaaacatccgcctgctgcgccagcaccagttccccgaagacgcaggtccgaccgcacatccggtgcgccccgcccgatatgaggagatgaacaatttctacaccatgaccgtttatgaaaaaggcgcggaagtggtgcggatgtatcacaccttgctcggcgaagagggcttccaaaaaggtatgaagctctatttccaacgccacgacggacaggctgttacctgcgacgatttccgcgcggcgatggtggacgcgaacggcatcaacctcgaccaattcgccttgtggtacagccaagcaggtacgccggttttagatgctcaagggcgtctgaaaaacaatgtgttcgagttaaccatcaaacaaaccgtgccgcccacgcccgatatggcggacaaacagccgatgatgattcccgtcaaaatcgggctgctgaactgcaacggcgaagcggtggcatttgattatcagggcaaacgcgcgaccgaagccgtgttgctgctgaccgaagccgaacagaccttccagttcgaaagcgtaaccgaagccgtcgttccctcgctgctgcgcgggttcagcgcgccggtgcatctgaactatccgtacagcgacgacgacctgctgcttctgctcgcccatgacagcgacgccttcacgcgctgggaagccgcacaaacgctctaccgccgtgccgtcgccgccaaccttgccgcgctttcagacggcgtcgagttgccgaaacacgaaaaactgcttgccgccgtcgaaaaagtcatttcagacgacctcttagacaacgctttcaaagccctgcttttgggtgtgccgtctgaagccgagctgtgggacggcgcggaaaacatcgacccgctgcgctaccatcaggcgcgcgaagccttgttggatatacttgccgtccgctttctgccgaaatggcacgaattgaaccgtcaggcggcgaagcaggaaaaccaaagctacgagtacagccccgaagccgccggttggcgcacgctgcgcaatgtctgccgcgccttcgtcctgcgcgccgatcccgcgcacatcgaaaccgttgccgagaaatacgccgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatatttcgccctcgtcggctcaagccgccgcagcgacaccctgcaacaggttcaaaccgccttgcagcatccgaagttcagcctcgaaaatcccaacaaagcccgctcgctcatcggcagcttcagccgcaacgtcccgcatttccacgcagaagacggcagcggctaccgcttcatcgccgacaaagtcatcgaaatcgaccgctttaacccgcaggtcgccgcccgcctggtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 41003 - protein, 867 aa, Neisseria meningitidis
MSKTVHYLKDYQTPAYHILKTDLHFDINEPQTIVKSRLTVEPKRVGEPLVLDGSAKLLSVKINGVAADYVLEGETLTIADVPSERFTVEVETEILPAENKSLMGLYASAGNLFTQCEPEGFRKITFYIDRPDVMSKFTTTIVADKKRYPVLLSNGNKIDGGEYSDGRHWVKWEDPFAKPSYLFALVAGDLAVTEDYFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPARYEEMNNFYTMTVYEKGAEVVRMYHTLLGEEGFQKGMKLYFQRHDGQAVTCDDFRAAMVDANGINLDQFALWYSQAGTPVLDAQGRLKNNVFELTIKQTVPPTPDMADKQPMMIPVKIGLLNCNGEAVAFDYQGKRATEAVLLLTEAEQTFQFESVTEAVVPSLLRGFSAPVHLNYPYSDDDLLLLLAHDSDAFTRWEAAQTLYRRAVAANLAALSDGVELPKHEKLLAAVEKVISDDLLDNAFKALLLGVPSEAELWDGAENIDPLRYHQAREALLDILAVRFLPKWHELNRQAAKQENQSYEYSPEAAGWRTLRNVCRAFVLRADPAHIETVAEKYAEMAQNMTHEWGILSAVNGNESDTRNRLLAQFADKFSDDALVMDKYFALVGSSRRSDTLQQVQTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 41004 - DNA, 540 bp, Neisseria gonorrhoeae
atgctttgtatgaattatcaatcaaactcaggcgaaggagtgcttgtagctaaaacatatttattgactgcattgataatgtctatggtaatctccggatgtcaagtcatccatgccaatcaaggtaaggttaatactaattctgctgtcatcgcaggtgcagacgctcacacgcctgaacatgtaacgggactgaccgaacaaaagcaggtgattgcaagtgattttatagtagcgtcagccaatccattagcaacacaagctggctatgatatcttaaagcaaggcggtagcgctgcagatgcgatggtggcggtgcagacgacactaagcttggtagagccacagtcgtcaggcttgggcggtggtgcatttgtgttgtattgggacaataccgccaaaacattgaccacatttgatgggcgtgagacggcaccgatgcgtgcgacgccagaattatttttggataaagatggttaaccattgaaatttatggaagcggtggtcgctcggtaggtacgcctgctatccctaaactga

SEQ ID NO: 41005 - protein, 179 aa, Neisseria gonorrhoeae
  misc_feature (160)..(160): Xaa can be any naturally occurring amino acid
  misc_feature (172)..(172): Xaa can be any naturally occurring amino acid
MLCMNYQSNSGEGVLVAKTYLLTALIMSMVISGCQVIHANQGKVNTNSAVIAGADAHTPEHVTGLTEQKQVIASDFIVASANPLATQAGYDILKQGGSAADAMVAVQTTLSLVEPQSSGLGGGAFVLYWDNTAKTLTTFDGRETAPMRATPELFLDKDGXPLKFMEAVVARXVRLLSLN

SEQ ID NO: 41006 - DNA, 546 bp, Neisseria meningitidis
atgccttgtatgaatcatcaatcaaactcaggcgaaggagtgcttgtggctaaaacatatttattgactgcattgataatgtctatgacaatctctggatgtcaagtcatccatgccaatcaaggtaaggttaatactcattctgctgtcatcacaggtgcagacgctcacacgcctgaacatgcaacgggactgaccgaacaaaagcaggtgattgcaagtgattttatggtagcgtcagccaatccattagcaacacaagctggctatgatatcttaaagcaaggcggtagcgctgcagatgcgatggtggcggtgcagacgacactaagcttggtagagccacagtcgtcaggcttgggcggtggtgcatttgtgttgtattgggataataccgccaaaacattgaccacatttgatgggcgtgagacggcaccgatgcgtgcgacgccggaattatttttggataaagatggtcaaccattgaaatttatggaagcggtggtcgtggtcgctcggtgggtacgcctgctatccctaaactga

SEQ ID NO: 41007 - protein, 181 aa, Neisseria meningitidis
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVVVARWVRLLSLN

SEQ ID NO: 41008 - DNA, 546 bp, Neisseria meningitidis; identical to SEQ ID NO: 41006

SEQ ID NO: 41009 - protein, 181 aa, Neisseria meningitidis; identical to SEQ ID NO: 41007

SEQ ID NO: 41010 - DNA, 813 bp, Neisseria gonorrhoeae
atgcggtttgtcttctgtttgggcggagagatagtttctgatccgtgtgatttccatttggtattcgtccgcgtcgaatctgccgctgaccagacagaaacgcagatacatcaaatacgtattcacggcatcggtttcgcaataattgcggatttccttcagcgtgcccgcgtggaacgcttcccacactttgctgccgtccatacccagcttgcccggaaagccgcacagtttcgccatatcgtccagcggcacattcgccctcggctggtaaagcgcgagcaaatccatcaaatcgcagtggcgttggtgataacggctgatgtagttgttccacttgaaatcgcggctgtcgccgaaatcgccgtcgcccgtatcccaatagcgcgcggcgttgatgccgtatatcagggagcggtaatgcagtacgggcaggtcgaaaccgccgccgttccagctgaccagttgcggcgtatgtttttcaaccaattcgaaaaacttggcaatcacgacttcttcgccatcgtccatctcgccgatggtgccgacatgaaccttgtcctgcccccagcgcatacagcaggaaaccgccacaacctgatggaggtggtgctgcataaaatcgccgccggtctgtgcgcggcgtttctgctgcgcgaacagcaccacttcgtcatccggcagggaagacggcaagtcatacaacgtacggataccctgcacatcgggtacggtttcaatatcgaaagccaaaatcgtattcatggcagtaccttgcattcaaaaacagacttgcgcctattgtgtcattaa

SEQ ID NO: 41011 - protein, 270 aa, Neisseria gonorrhoeae
MRFVFCLGGEIVSDPCDFHLVFVRVESAADQTETQIHQIRIHGIGFAIIADFLQRARVERFPHFAAVHTQLARKAAQFRHIVQRHIRPRLVKREQIHQIAVALVITADVVVPLEIAAVAEIAVARIPIARGVDAVYQGAVMQYGQVETAAVPADQLRRMFFNQFEKLGNHDFFAIVHLADGADMNLVLPPAHTAGNRHNLMEVVLHKIAAGLCAAFLLREQHHFVIRQGRRQVIQRTDTLHIGYGFNIESQNRIHGSTLHSKTDLRLLCH

SEQ ID NO: 41012 - DNA, 672 bp, Neisseria meningitidis
atgcggcttttccccggcttgtgcggacaggtaattccgcatccgtttgatttccatttcgtattcgtccgcatccagcctgccgctgaccagacagaaacgcaggtacatcagataagtgtttgccgcgtcggtttcgcaataattgcggatttccttcagcctgcccgtatggaatgcctcccaaaccttgctgccgtccatacccagcttgcccggaaaaccgcacagtttcgccatatcgtccagcggcacgtttgccctcggctggtaaagcgcgagcaaatccatcaaatcgcagtggcgttggtgataacggctgatgtagttgttccacttgaaatcgcggctgtcgccgaaatcgccgtcgcccatatcccaatagcgcgcggcgttgatgccgtatatcagggagcggtaatgcagtacgggcagatcgaaaccgccgccgttccaactgaccagttgcggcgtatgtttttcaatcaattcgaaaaatttagcaatgaccacttcctcgccgtcatccatctcgccgatggtgccgacatgtactttatcctgcccccaacgcatgcagcacgaaatcgccacaacctgatgaagatgatgctgcataaaatcgccgcccgtctgagcacggcgtttgtgctgggcaatcagcaccacttg

SEQ ID NO: 41013 - protein, 224 aa, Neisseria meningitidis
MRLFPGLCGQVIPHPFDFHFVFVRIQPAADQTETQVHQISVCRVGFAIIADFLQPARMECLPNLAAVHTQLARKTAQFRHIVQRHVCPRLVKREQIHQIAVALVITADVVVPLEIAAVAEIAVAHIPIARGVDAVYQGAVMQYGQIETAAVPTDQLRRMFFNQFEKFSNDHFLAVIHLADGADMYFILPPTHAARNRHNLMKMMLHKIAARLSTAFVLGNQHHL

SEQ ID NO: 41014 - DNA, 812 bp, Neisseria meningitidis
atgcggtttgtcttctgtttgggcggagagatagtttctgatccgcttgatttccatttcgtattcgtctgcgtcgaatctgccgctgaccagacagaaacgcagatacatcagataggtatttaccgcatcggtttcgcaataattgcggatttccttcagcctgcccgcgtggaacgcctcccacaccttgctgccgtccatacccagcttgcccggaaaaccgcacagtttcgccatatcgtccaacggcacattcgccctcggctggtaaagcgcgagcaaatccatcaaatcgcaatgacgttggtggtagcggctgatgtagttgttccacttgaaatcgcggctgtcgccgaaatcgccgtcgcccatatcccaatagcgcgcggcgttgatgccgtgtagcagcgaacggtaatgcagaaccggcaggtcgaaaccgccgccgttccaactgaccagttgcggcgtatgtttttcaatcaactcgaaaaatttggcgataaccacttcctcgccgtcatccatctcgccgattgtaccgacatggactttatcctgcccccaacgcatgcagcacgaaatcgccacaatctgatgaagatgatgctgcataaaatccccacccgtctgagcacggcgtttttgctgggcaaacagcaccacttcatcgtcgggcagcgaggacggcaagtcatacagcgtacggatacactgcacatcgggtacggtttcaatatcgaaagccaaaatcgtggtcatgacagcaccttgtatttaaaacagacttgcgcctattgtgtcattaa

SEQ ID NO: 41015 - protein, 269 aa, Neisseria meningitidis
  misc_feature (262)..(262): Xaa can be any naturally occurring amino acid
MRFVFCLGGEIVSDPLDFHFVFVCVESAADQTETQIHQIGIYRIGFAIIADFLQPARVERLPHLAAVHTQLARKTAQFRHIVQRHIRPRLVKREQIHQIAMTLVVAADVVVPLEIAAVAEIAVAHIPIARGVDAVQRTVMQNRQVETAAVPTDQLRRMFFNQLEKFGDNHFLAVIHLADCTDMDFILPPTHAARNRHNLMKMMLHKIPTRLSTAFLLGKQHHFIVGQRGRQVIQRTDTLHIGYGFNIESQNRGHDSTLYLKXDLRLLCH

SEQ ID NO: 41016 - DNA, 321 bp, Neisseria gonorrhoeae
atgcgccgcatcgttaaaaaacaccagcccgtaaacgcgccacatatcgttttggaaattcggataatgaaactgcatcgcgcgtttgtcttccttgggcggaaacgtccccatcatcatgaccgcagccttcggcggcaacacgggatcgaagggatgggtttcgatttcaagcagattttcagacacgttcaatcctccaacaggcaaagcggcagacagccggtttgcaccaaaccgccaaacacggcaagccttcaaacagcattatcacgccctgccgttttcggttacaatgccgacatcaaacggatactgtaa

SEQ ID NO: 41017 - protein, 106 aa, Neisseria gonorrhoeae
MRRIVKKHQPVNAPHIVLEIRIMKLHRAFVFLGRKRPHHHDRSLRRQHGIEGMGFDFKQIFRHVQSSNRQSGRQPVCTKPPNTASLQTALSRPAVFGYNADIKRIL

SEQ ID NO: 41018 - DNA, 321 bp, Neisseria meningitidis
atgcgccgcatcattaaaaaacaccagcccataaacgcgccacatatcgttttggaaattcggataatgaaactgcatcgcgcgtttgtcttccttgggcggaaacgtccccatcatcatgacagcagccttcggcggcaacacgggatcgaagggatgggtttcgatttcaagcagattttcagacacgttcaatcctccaacaggcaaaacggcagacagccggtttgcaccaaaccgccaaacacggcaagccttcaaacagcattatcacgccctgccgttttcggttacaatgccgacatcaaacggatactgtaa

SEQ ID NO: 41019 - protein, 106 aa, Neisseria meningitidis
MRRIIKKHQPINAPHIVLEIRIMKLHRAFVFLGRKRPHHHDSSLRRQHGIEGMGFDFKQIFRHVQSSNRQNGRQPVCTKPPNTASLQTALSRPAVFGYNADIKRIL

SEQ ID NO: 41020 - DNA, 321 bp, Neisseria meningitidis
atgcgccgcatcattaaaaaacaccagcccgtaaacgcgccacatatcgttttggaaattcggataatgaaactgcatcgcgcgtttgtcttccttgggcggaaacgtccccatcatcatgaccgcagccttcggcggcaacacggaatcgaagggatgggtttcgatttcaagcagattttcagacacgttcaatcctccaacaggcaaaacggcagacagccggtttgcaccaaaccgccaaacacggcaagccttcaaacagcattatcacgccctgccgttttcggttacaatgccgacatcaaacggatactgtaa

SEQ ID NO: 41021 - protein, 106 aa, Neisseria meningitidis
MRRIIKKHQPVNAPHIVLEIRIMKLHRAFVFLGRKRPHHHDRSLRRQHGIEGMGFDFKQIFRHVQSSNRQNGRQPVCTKPPNTASLQTALSRPAVFGYNADIKRIL

SEQ ID NO: 41022 - DNA, 456 bp, Neisseria gonorrhoeae
atgacttgttgcaggaactgcttggcgcgttcgtgtttcgggttggtgaaaaacgcttccggcgtttcgtcttcaaggatttgccctttatcgacgaaaatcacgcggtcggcaacttcgcgggcaaaccccatttcgtgggttacgcacatcatcgtcatgccgctttccgccaagtctttcatcactttcaacacttcgccgaccatttcggggtcgagtgcggaagtcggctcgtcaaacagcatcacgcgcggctccatcgccagcccgcgcgcaatcgccacgcgttgctgctggccgccggaaagttgggaagggaaggcgtcttttttgtgtgccagtccgacgcgttccaaaagctccattgcctttttctccgcctgttccgcattttgccccttaaccttcatcggtgcgagggtgatgttgtccaacacggtcaggtgcgggtag

SEQ ID NO: 41023 - protein, 151 aa, Neisseria gonorrhoeae
MTCCRNCLARSCFGLVKNASGVSSSRICPLSTKITRSATSRANPISWVTHIIVMPLSAKSFITFNTSPTISGSSAEVGSSNSITRGSIASPRAIATRCCWPPESWEGKASFLCASPTRSKSSIAFFSACSAFCPLTFIGARVMLSNTVRCG

SEQ ID NO: 41024 - DNA, 456 bp, Neisseria meningitidis
atgacctgttgcaggaactgcttggcgcgttcgtgtttcgggttggtaaaaaacgcttcgggcgtttcgtcttcgaggatttgccctttatcgacgaaaatcacgcggtcggcaacttcgcgggcaaaccccatttcgtgggttacgcacatcatcgtcatgccgctttctgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagctccattgcctttttctccgcctgttccgcattttgccccttaaccttcatcggtgcgagggtaatgttttccaacacggtcaggtgcgggtag

SEQ ID NO: 41025 - protein, 151 aa, Neisseria meningitidis
MTCCRNCLARSCFGLVKNASGVSSSRICPLSTKITRSATSRANPISWVTHIIVMPLSAKSFITFNTSPTISGSSAEVGSSNNITRGSIAKPRAIATRCCWPPESWEGKASFLCASPTRSKSSIAFFSACSAFCPLTFIGARVMFSNTVRCG

SEQ ID NO: 41026 - DNA, 456 bp, Neisseria meningitidis
atgacctgttgcaggaactgcttggcgcgttcgtgtttcgggttggtaaaaaacgcttccggcgtttcgtcttcgaggatttgccctttatcgacgaaaatcacgcggtcggcaacttcgcgggcaaaccccatttcgtgggttacgcacatcatggtcataccgctttccgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagttccatcgcttttttctctgcctgttccgcattttgacctttaaccttcatcggtgcgagggtaatgttttccaacacggtcaggtgcgggtag

SEQ ID NO: 41027 - protein, 150 aa, Neisseria meningitidis
MTCCRNCLARSCFGLVKNASGVSSSRICPLSTKITRSATSRANPISWVTHIMVIPLSAKSFITFNTSPTISGSSAEVGSSNNITRGSIAKPRAIATRCCWPPESWEGKASFLCASPTRSKSSIAFFSACSAFPLTFIGARVMFSNTVRCG

SEQ ID NO: 41028 - DNA, 447 bp, Neisseria gonorrhoeae
atgatcagcagggtaacaatcaaaacgcctttcaatgcaccgaatacaccgcccaaaatgcggttggcaaagcccagaccgaccgccgaaactgcgccggtcagcagcgaacggagcattttctggatcagacaggcaatgacgaacagggaaatgaatgacagagccaatgcaaacaggcggggttggaacgaggcaaaggcgaggtcggcgaagggtgcggcaaagagtttggcaaaaaagaaggaaaccacccatgccaccatcgaacctgcttccgcaatcacgccgcgcatcgtggaaatgacgatgcaggcggcgatgacggcggaggcgaggaggtcggcaatggggaggctattcattcgttacctggccggcgatgccgtgcacgcgcagtttgttcaaatcgcgttcggcatcccttgcgtttttatagttgcttga

SEQ ID NO: 41029 - protein, 148 aa, Neisseria gonorrhoeae
MISRVTIKTPFNAPNTPPKMRLAKPRPTAETAPVSSERSIFWIRQAMTNREMNDRANANRRGWNEAKARSAKGAAKSLAKKKETTHATIEPASAITPRIVEMTMQAAMTAEARRSAMGRLFIRYLAGDAVHAQFVQIAFGIPCVFIVA

SEQ ID NO: 41030 - DNA, 447 bp, Neisseria meningitidis
atgaccagcagggtaacaatcaaaacgcctttcaatgcaccgaatacgccgcccaaaatgcggttggcaaagcccaaaccgaccgccgaaactgcgctggtcagcagcgaacggagcattttctggatcagacaggcaatgacgaacagggaaatgaacgacagagccaatgcaaacaggcggggttggaacgaggcaaaggcgaggtcggcgaaggaggcggcaaagagtttggcgaaaaagaaggaaaccacccatgccgccattgagcctgcctccgcaatcacgccgcgcatcgcggatagcacgatgcaggcggcgatgacggcggagacgaggaggtcggcaatggggaggctattcattcgttacctgaccggcgataccgtgtacgcgcaatttgttcaaatcgcgttcggcatcccttgcgtttttatagttgcttga

SEQ ID NO: 41031 - protein, 148 aa, Neisseria meningitidis
MTSRVTIKTPFNAPNTPPKMRLAKPKPTAETALVSSERSIFWIRQAMTNREMNDRANANRRGWNEAKARSAKEAAKSLAKKKETTHAAIEPASAITPRIADSTMQAAMTAETRRSAMGRLFIRYLTGDTVYAQFVQIAFGIPCVFIVA

SEQ ID NO: 41032 - DNA, 447 bp, Neisseria meningitidis
atgaccagcagggtaataatcaaaatgcctttcaatgcaccgaatacgccgcccaaaatgcggttggcaaagcccaaaccgaccgccgaaactgccccggtcagcagcgagcggagtattttctggatcagacaggcaatgacgaatagggaaatgaacgacagagccaatgcaaacaggcggggttggaacgatgcaaaggcgatgtcggcgaagggtgcggcaaagagtttggcgaaaaaaaaggcaaccacccatgccgccattgagccagcctccgcaatcacgccgcgcatcgcggatagcacgatgcaggcggcgatgatggcggagacgaggaggtcggcaacggggaggttattcattcgttacctgaccggcgataccgtgtacgcgcaatttgttcaaatcgcgttcggcatcccttgcgtttttatagttgcttga

SEQ ID NO: 41033 - protein, 148 aa, Neisseria meningitidis
MTSRVIIKMPFNAPNTPPKMRLAKPKPTAETAPVSSERSIFWIRQAMTNREMNDRANANRRGWNDAKAMSAKGAAKSLAKKKATTHAAIEPASAITPRIADSTMQAAMMAETRRSATGRLFIRYLTGDTVYAQFVQIAFGIPCVFIVA

SEQ ID NO: 41034 - DNA, 627 bp, Neisseria gonorrhoeae
atgaggaaaatccgcaccaaaatctgcggcatcaccacaccggaagacgcactgtatgccgcccacgccggcgcagacgcattgggactggttttttacccccaaagcccccgcgctatcgacatcattaaagcacaaaaaatcgccgccgcactgccgccgtttgtcagcgttgtcgcccttttcgtcaacgaaagcgcgcaaaacatccgccgcatccttgccgaagtgccgatacacatcatccaattccacggcgacgaagacgatgcattctgccggcagttcgaccgcccctatattaaagccattcgtgttcagacggcatcagacatccgaaacgccgccacgcgcttccccaacgctcaggcactgctgttcgatgcctatcacccttcggaatacggcggcaccggacaccgcttcgactggacgctgttggcggaatattcgggcaagccgtgggtgcttgccggcgggctgacccctgaaaacgtcggcgaagccgtccgcatcaccggagcggaagcggtcgacgtatccggcggcgtggaagcgtctaaaggcaaaaaagaccccgccaaagtcgccgcctttatcgcaaccgccaaccgcctatcccgttaa

SEQ ID NO: 41035 - protein, 208 aa, Neisseria gonorrhoeae
MRKIRTKICGITTPEDALYAAHAGADALGLVFYPQSPRAIDIIKAQKIAAALPPFVSVVALFVNESAQNIRRILAEVPIHIIQFHGDEDDAFCRQFDRPYIKAIRVQTASDIRNAATRFPNAQALLFDAYHPSEYGGTGHRFDWTLLAEYSGKPWVLAGGLTPENVGEAVRITGAEAVDVSGGVEASKGKKDPAKVAAFIATANRLSR

SEQ ID NO: 41036 - DNA, 627 bp, Neisseria meningitidis
atgaggaaaatccgcaccaaaatctgcggcatcaccacaccggaagacgcagctgccgccgcagcggcaggtgcggatgccgtcgggctggtctttttccaaggcagcagccgggccgtcgatattgcccgcgccaaaaaaatcaccgccgcactgccgccgtttgtcagcgttgtcgcccttttcgtcaacgaaagcgcgcaaaacatccgccgcatccttgccgaagtgccgatacacatcatccaattccacggcgacgaagacgacgcattctgccgccagttccaccgcccctatatcaaagccattcgtgttcagacggcatcagacatccgaaacgccgccacgcgcttccccgacgctcaggcactgctgttcgatgcctaccatccttcggaatacggcggcaccggaaaccgcttcgactggacgctgctggcggaatattcgggcaaaccgtgggtgcttgccggcgggctgacccctgaaaacgtcggcgaagccgtccgcatcaccggagcggaatcggtcgatgtatccggcggtgtggaagcgtctaaaggcaaaaaagatgccgccaaagtcgccgcctttatcgcaaccgccaaccgcctatcccgttaa

SEQ ID NO: 41037 - protein, 208 aa, Neisseria meningitidis
MRKIRTKICGITTPEDAAAAAAAGADAVGLVFFQGSSRAVDIARAKKITAALPPFVSVVALFVNESAQNIRRILAEVPIHIIQFHGDEDDAFCRQFHRPYIKAIRVQTASDIRNAATRFPDAQALLFDAYHPSEYGGTGNRFDWTLLAEYSGKPWVLAGGLTPENVGEAVRITGAESVDVSGGVEASKGKKDAAKVAAFIATANRLSR

SEQ ID NO: 41038 - DNA, 627 bp, Neisseria meningitidis
atgaggaaaatccgcaccaaaatctgcggcatcaccacaccggaagacgcactgtatgccgcccacgccggcgcagacgcattgggactggttttttacccccaaagcccccgcgctgtcgacatcattaaagcacaaaaaatcaccgccgcactgccgccgtttgtcagcgttgtcgcccttttcgtcaacgaaagcgcgcaaaacatccgccgcatccttgccgaagtaccgatacacatcatccaattccacggcgacgaagacgacgcattctgccgccagttccaccgcccctatatcaaggccattcgtgttcagacggcatcagacatccgaaacgccgccgaccgcttccccgacgctcaggcactgctgttcgatgcctaccatccttcggaatacggcggcaccggacaccgcttcgactggacgctgttggcggaatattcgggcaaaccgtgggtgcttgccggcgggctgacccctgaaaacgtcgacgaagccatccgcatcaccggagcggaagcggtcgatgtatccggcggcgtggaagcgtctaaaggcaaaaaagacccagccaaagttgccgcctttatcgcaaccgccaaccgcctatcccgttaa

SEQ ID NO: 41039 - protein, 208 aa, Neisseria meningitidis
MRKIRTKICGITTPEDALYAAHAGADALGLVFYPQSPRAVDIIKAQKITAALPPFVSVVALFVNESAQNIRRILAEVPIHIIQFHGDEDDAFCRQFHRPYIKAIRVQTASDIRNAADRFPDAQALLFDAYHPSEYGGTGHRFDWTLLAEYSGKPWVLAGGLTPENVDEAIRITGAEAVDVSGGVEASKGKKDPAKVAAFIATANRLSR

SEQ ID NO: 41040 - DNA, 924 bp, Neisseria gonorrhoeae
atggatattgaaaccttccttgcaggggaacgcgccgccggcggataccgttgcggcttcgtggcgattgtcggtcgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgccgggctttcaaaccgaccaccgcaacgcgctcaacgacaggctgaatcaaaatgttaccgaggcgctcggcggtgtggatgtggtggttttcgtcgtggaggcgatgcgccttaccgatgccgaccgcgtcgtgttgaaacaactgcccaagcacacgccggtcattttagtgatcaacaaaatcgacaaggacaaggcgaaagaccgttacgcgctggaggcgtttgttgcccaagtgcgcgccgaatttgaatttgcggcggcggaggcggtcagtgcgaaacacggtttgcggattgccaacctgttggagctgctcaagccgtatctgcccgaaagcgtaccgatgtatcccgaagacatggttacggacaaatcggcgcgttttttggcgatggaaatcgtgcgtgaaaaactcttccgctatttgggcgaggagctgccttatgcgatgaacgtcgaagtggagcagtttgaagagggagacggtttgaaccgcatctacatcgccgttttggtcgacaaagaaagccaaaaggcgattttgatcggtaaaggcggggagcgtttgaaaaaaatttccaccgaagcgcggctggatatggaaaaactgtttgataacaaagtatttttgaaggtctgggtcaaagtcaaatccggttgggcagacgacattcgcttcctgcgcgagctgggtttgtag

SEQ ID NO: 41041 - protein, 307 aa, Neisseria gonorrhoeae
MDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRLTDADRVVLKQLPKHTPVILVINKIDKDKAKDRYALEAFVAQVRAEFEFAAAEAVSAKHGLRIANLLELLKPYLPESVPMYPEDMVTDKSARFLAMEIVREKLFRYLGEELPYAMNVEVEQFEEGDGLNRIYIAVLVDKESQKAILIGKGGERLKKISTEARLDMEKLFDNKVFLKVWVKVKSGWADDIRFLRELGL

SEQ ID NO: 41042 - DNA, 924 bp, Neisseria meningitidis
atggatattgaaaccttccttgcaggggaacgcgccgccggcggataccgttgcggcttcgtagcgattgtcggccgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgcccggctttcaaaccgaccaccgcaacgcgctcaacgacaggctgaatcaaaatgttaccgaggcgctcggcggcgtggatgtggtggttttcgtcgtggaggcgatgcgctttaccgatgccgaccgcgtcgtgttgaaacaactgcccaagcacacgccggtcattttagtggtcaacaaaatcgacaaggacaaggcgaaagaccgttacgcgctggaggcgtttgttgcccaagtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttggcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcaattttaatcggtaaaggcggagaacgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtag

SEQ ID NO: 41043 - protein, 307 aa, Neisseria meningitidis
MDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRFTDADRVVLKQLPKHTPVILVVNKIDKDKAKDRYALEAFVAQVRAEFEFAAAEAVSAKHGLRIANLLELIKPYLPESVPMYPEDMVTDKSARFLAMEIVREKLFRYLGEELPYAMNVEVEQFEEEDGLNRIYIAVLVDKESQKAILIGKGGERLKKISTEARLDMEKLFDTKVFLKVWVKVKSGWADDIRFLRELGL

SEQ ID NO: 41044 - DNA, 924 bp, Neisseria meningitidis
atggatattgaaaccttccttgcaggggaacgcgccgccgacggataccgttgcggcttcgtagcgattgtcggccgtccgaacgtgggcaaatcaacgctgatgaatcatctcatcggtcagaaaatcagtattaccagcaaaaaggcgcagacgacgcgcaaccgcgtaacggggatttataccgacgataccgcgcagtttgtgtttgtcgatacgcccggttttcaaaccgaccaccgcaacgcgctcaacgaccgtttgaatcaaaacgttaccgaggcactcggcggcgtggatgtggtggttttcgtcgtggaagcgatgcgttttaccgatgccgaccgcgtcgtgttgaaacaactgcccaagcacacgccggtcattttagtggtcaacaaaatcgataaggacaaggcgaaagaccgttacgcgctggaggcgtttgttgcccaggtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttagcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcgattttaatcggcaaaggcggggagcgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtag

SEQ ID NO: 41045 - protein, 307 aa, Neisseria meningitidis
MDIETFLAGERAADGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRFTDADRVVLKQLPKHTPVILVVNKIDKDKAKDRYALEAFVAQVRAEFEFAAAEAVSAKHGLRIANLLELIKPYLPESVPMYPEDMVTDKSARFLAMEIVREKLFRYLGEELPYAMNVEVEQFEEEDGLNRIYIAVLVDKESQKAILIGKGGERLKKISTEARLDMEKLFDTKVFLKVWVKVKSGWADDIRFLRELGL

SEQ ID NO: 41046 - DNA, 426 bp, Neisseria gonorrhoeae
atgaaaacagcccgccgccgttcccgcgagcttgccgtacaagccgtttaccaatcccttatcaaccgcaccgccgcgcccgaaattgctaaaaacatccgcgaaatgtccgactttgccaaagcggacgaagaattgttcaacaaactcttcttcggcacacaaaccaatgcagcggactacatccaaaaaatccgcccgctgctcgacagggacgaaaaagacctcaaccccatcgaacgcgccgttttgctgaccgcctgccacgagctttccgctatgcccgaaacgccctaccccgtcattatcaacgaagccatcgaagttaccaaaaccttcggcggcacggacgggcacaaattcgtcaacggcatcctcgacaaactcgccgcccaaatccgcccagacgagcccaaacgccgttga

SEQ ID NO: 41047 - protein, 141 aa, Neisseria gonorrhoeae
MKTARRRSRELAVQAVYQSLINRTAAPEIAKNIREMSDFAKADEELFNKLFFGTQTNAADYIQKIRPLLDRDEKDLNPIERAVLLTACHELSAMPETPYPVIINEAIEVTKTFGGTDGHKFVNGILDKLAAQIRPDEPKRR

SEQ ID NO: 41048 - DNA, 426 bp, Neisseria meningitidis
atgaaaacagcccgccgccgttcccgcgagcttgccgtacaagccgtttaccaatcccttatcaaccgcaccgccgcgcccgaaattgctaaaaacatccgcgaaatgtccgactttgccaaggcagacgaagaattgttcaacaaacttttcttcggcacgcaaaccaatgcggcagagtatatccgacaaatccgcccgctacttgacagggacgaaaaagacctcaaccccatcgaacgcgccgttttgctgaccgcctgccacgagctgtccgccatgcccgaaacgccctaccccgtcattatcaacgaagccatcgaagttaccaaaaccttcggcggcacggacgggcacaaattcgtcaacggcatcctcgacaaactcgccgcccaaatccgccccgacgagcccaaacgccgttga

SEQ ID NO: 41049 - protein, 141 aa, Neisseria meningitidis
MKTARRRSRELAVQAVYQSLINRTAAPEIAKNIREMSDFAKADEELFNKLFFGTQTNAAEYIRQIRPLLDRDEKDLNPIERAVLLTACHELSAMPETPYPVIINEAIEVTKTFGGTDGHKFVNGILDKLAAQIRPDEPKRR

SEQ ID NO: 41050 - DNA, 426 bp, Neisseria meningitidis
atgaaaacagcccgccgccgttcccgcgagcttgccgtacaagccgtttaccaatcccttatcaaccgcaccgccgcgcccgagattgctaaaaacatccgcgaaatgcccgactttgccaaggcagacgaagaattgttcaacaaacttttcttcggcacgcaaaccaatgcggcagagtacatccgacaaatccgccccctgctcgaccgcgacgaaaaagacctcaaccccatcgaacgcgccgtcctgctgaccgcctgccacgagctgtccgccatgcccgaaacgccctaccccgtcatcatcaacgaagccatcgaagtaaccaaaaccttcggcggcacggacgggcacaaattcgtcaacggcatcctcgacaaactcgccgcccaaatccgtcccgacgagcccaaacgccgttga

SEQ ID NO: 41051 - protein, 141 aa, Neisseria meningitidis
MKTARRRSRELAVQAVYQSLINRTAAPEIAKNIREMPDFAKADEELFNKLFFGTQTNAAEYIRQIRPLLDRDEKDLNPIERAVLLTACHELSAMPETPYPVIINEAIEVTKTFGGTDGHKFVNGILDKLAAQIRPDEPKRR

SEQ ID NO: 41052 - DNA, 477 bp, Neisseria gonorrhoeae
atgaacaccatcgcccccaacctcgacggcaaacacctccgcatcggcatcgtacaggcacgcttcaccaacgaaatcggcagccaaatgctcaaagtctgctgccgcaccctccaagaattgggcgtagcagacgaaaacatcaccgtcgccaccgtacccggcgcgcttgaaatccccatcgcgctgatgaactttgcctcttccgaaaaatttgacgcactgattgccatcggcgtcgtcatccgtggcgaaacctaccatttcgagctggttgccaacgaatccggcgcagggatcggccgcgtcgcactcgactacaacatcccgattgccaacgccgtcctgaccaccgaaaacgacgcgcaggcaattgaacggattggagaaaaagcctcggatgccgccaaagtcgccgtagaatgcgccaacctcgtcaaccttctgctcgaagaacagtttgaagacgaagaataa

SEQ ID NO: 41053 - protein, 158 aa, Neisseria gonorrhoeae
MNTIAPNLDGKHLRIGIVQARFTNEIGSQMLKVCCRTLQELGVADENITVATVPGALEIPIALMNFASSEKFDALIAIGVVIRGETYHFELVANESGAGIGRVALDYNIPIANAVLTTENDAQAIERIGEKASDAAKVAVECANLVNLLLEEQFEDEE

SEQ ID NO: 41054 - DNA, 477 bp, Neisseria meningitidis
atgaacaccatcgcccccaacctcgacggcaaacacctccgcatcggcatcgtacaggcacgcttcaccaacgaaatcggcagcgaaatgctcaaagtctgctgccgcaccctccaagaattgggcgtggcagacgaaaacattaccgtcgccaccgtacccggcgcgcttgaaatccccatcgcgctgatgaactttgcctcttccgaaaagtttgacgcactgattgccatcggcgtcgtcatccgtggcgaaacctaccatttcgagctggtttccaacgaatccggagcaggcgtcagccgcgtcgcactcgactacaatatcccgattgccaatgccgtcctaaccaccgaaaacgacgcgcaggcaatcgaacggattgaagaaaaagcctcggatgccgccaaagtcgccgtcgaatgcgccaacctcgtcaacctgctgctcgaagaacagtttgaagacgaagaataa

SEQ ID NO: 41055 - protein, 158 aa, Neisseria meningitidis
MNTIAPNLDGKHLRIGIVQARFTNEIGSEMLKVCCRTLQELGVADENITVATVPGALEIPIALMNFASSEKFDALIAIGVVIRGETYHFELVSNESGAGVSRVALDYNIPIANAVLTTENDAQAIERIEEKASDAAKVAVECANLVNLLLEEQFEDEE

SEQ ID NO: 41056 - DNA, 477 bp, Neisseria meningitidis
atgaacaccatcgcccccaacctcgacggcaaacacctccgcatcggcatcgtacaggcacgcttcaccaacgaaatcggcagcgaaatgctcaaagtctgctgccgcaccctccaagaattgggcgtggcagacgaaaacattaccgtcgccaccgtacccggcgcgcttgaaatccccatcgcgctgatgaactttgcctcttctgaaaaatttgacgcactgattgccatcggcgtcgttatccgtggcgaaacctaccatttcgagctggtttccaacgaatccggagcaggggtcagccgcgtcgcactcgactacaacatcccgattgccaatgccgtcctgaccacggaaaacgacgcacaggcaatcgaacggattgaagaaaaagcctcggatgccgccaaagtcgccgtagaatgcgccaacctcgtcaacctcctgctcgaagaacagtttgaagacgaagaataa

SEQ ID NO: 41057 - protein, 158 aa, Neisseria meningitidis; identical to SEQ ID NO: 41055

SEQ ID NO: 41058 - DNA, 597 bp, Neisseria gonorrhoeae
atgccgcagattttggtgcggattttcctcattcggtattcctttatttgggaaacggtgcgcttgtgccgtttcagacggcattcccgatcagtcgattttgatgtattcgacagaaaggatttcaatttcctcacggccttccggcgtgttcaaaaccacttcgtcgccttcgcgcgctttaatcaggcaacgcgccaacggcgaaatccaagaaattttgttttgcgcggtatcgatttcatcgacgccgacgattttgacggtttgctcgcgcccgtcgccgcgcaacagaccgacggtcgcgccgaaaaatacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttattgaccagttgataaagctcgtctttcaatgcctgccatccggcgggcgtaatgtagtttttggtttcggtactcatattgtgtgcggatga

SEQ ID NO: 41059 - protein, 198 aa, Neisseria gonorrhoeae
MPQILVRIFLIRYSFIWETVRLCRFRRHSRSVDFDVFDRKDFNFLTAFRRVQNHFVAFARFNQATRQRRNPRNFVLRGIDFIDADDFDGLLAPVAAQQTDGRAEKYLVGRFAQFGIDDDGSLQTFGQETDAAVDFAHTAFAVKIVAVFAAVAVACRPVDDLDDFGAFFIDQLIKLVFQCLPSGGRNVVFGFGTHIVCG

SEQ ID NO: 41060 - DNA, 597 bp, Neisseria meningitidis
atgccgcagattttggtgcggattttcctcattcggtattcctttatttgggaaacggcgcgcttttgccgtttcagacggcattcccgatcagtcgattttgatgtattcgacagaaaggatttcaatttcctcacgcccttccggcgtgttcaaaaccacttcgtcgccttcgcgcgctttaatcagacaacgagccagcggcgaaatccaagaaattttgttttgcgcggtatcgatttcatcgatgccgacgattttgacggtttgctcgcgcccgtcgtcgcgcaacagtccgaccgtcgcgccgaaaaacacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttgttgaccagttgataaagctcgtctttcaatgcctgccatccggcgggcgtaatgtagtttttggtttcggtactcatattgtgtgcggatga

SEQ ID NO: 41061 - protein, 198 aa, Neisseria meningitidis
MPQILVRIFLIRYSFIWETARFCRFRRHSRSVDFDVFDRKDFNFLTPFRRVQNHFVAFARFNQTTSQRRNPRNFVLRGIDFIDADDFDGLLAPVVAQQSDRRAEKHLVGRFAQFGIDDDGSLQTFGQETDAAVDFAHTAFAVKIVAVFAAVAVACRPVDDLDDFGAFFVDQLIKLVFQCLPSGGRNVVFGFGTHIVCG

SEQ ID NO: 41062 - DNA, 597 bp, Neisseria meningitidis
atgccgcagattttggtgcggattttcctcattcggtattcctttatttgggaaacggcgcgtttgtgccgtttcagacggcattcccgatcagtcgattttgatgtattcgacagaaaggatttcaatttcctcacgcccttccggcgtgtttaaaaccacttcgtcgccttcacgcgctttaatcagacaacgagccagcggcgaaatccaagaaattttgttttgcgcggtatcgatttcatcgatgccgacgattttgacggtttgctcgcgcccgtcgccgcgcaacagaccgacggtcgcgccgaaaaacacttggtcggtcgcttcgcgcaattcgggatcaacgacgacggcggcttccaaacgcttggtcaggaaacggatgcggcggtcgatttcgcgcatacggcgtttgccgtaaaggtagtcgccgttttcgctgcggtcgccgttgcctgccgcccagttgacgatttggacgatttcggggcgttctttattaaccagttgataaagctcgtctttcaatgcctgccatccggcgggcgtaatgtagtttttggtttcggtactcatattgtgtgcggatga

SEQ ID NO: 41063 - protein, 197 aa, Neisseria meningitidis
MPQILVRIFLIRYSFIWETARLCRFRRHSRSVDFDVFDRKDFNFLTPFRRVNHFVAFTRFNQTTSQRRNPRNFVLRGIDFIDADDFDGLLAPVAAQQTDGRAEKHLVGRFAQFGINDDGGFQTLGQETDAAVDFAHTAFAVKVVAVFAAVAVACRPVDDLDDFGAFFINQLIKLVFQCLPSGGRNVVFGFGTHIVCG

SEQ ID NO: 41064 - DNA, 498 bp, Neisseria gonorrhoeae
atgaatagcctccccattgccgacctcctcgcctccgccgtcatcgccgcctgcatcgtcatttccacgatgcgcggcgtgattgcggaagcaggttcgatggtggcatgggtggtttccttcttttttgccaaactctttgccgcacccttcgccgacctcgcctttgcctcgttccaaccccgcctgtttgcattggctctgtcattcatttccctgttcgtcattgcctgtctgatccagaaaatgctccgttcgctgctgaccggcgcagtttcggcggtcggtctgggctttgccaaccgcattttgggcggtgtattcggtgcattgaaaggcgttttgattgttaccctgctgatcatgcttgcttcaaaaaccgacctgcccgataccgaagaatggcaacagtcctataccgtaccgtttttcgtatcgctttccgaagcggtgttaaaccatacggacaacgcacccgaatccctcgacgacgactaa

SEQ ID NO: 41065 - protein, 165 aa, Neisseria gonorrhoeae
MNSLPIADLLASAVIAACIVISTMRGVIAEAGSMVAWVVSFFFAKLFAAPFADLAFASFQPRLFALALSFISLFVIACLIQKMLRSLLTGAVSAVGLGFANRILGGVFGALKGVLIVTLLIMLASKTDLPDTEEWQQSYTVPFFVSLSEAVLNHTDNAPESLDDD

SEQ ID NO: 41066 - DNA, 498 bp, Neisseria meningitidis
atgaatagcctccccattgccgacctcctcgtctccgccgtcatcgccgcctgcatcgtgctatccgcgatgcgcggcgtgattgcggaggcaggctcaatggcggcatgggtggtttccttctttttcgccaaactctttgccgcctccttcgccgacctcgcctttgcctcgttccaaccccgcctgtttgcattggctctgtcgttcatttccctgttcgtcattgcctgtctgatccagaaaatgctccgttcgctgctgaccagcgcagtttcggcggtcggtttgggctttgccaaccgcattttgggcggcgtattcggtgcattgaaaggcgttttgattgttaccctgctggtcatgcttgcttcaaaaaccgacctgcccgataccgaagaatggcggcaatcttacacactgccgtttttcgtatcgctttccgaagccgtgttgaaccatagcggcggcacggcggaaactccggaagacgattga

SEQ ID NO: 41067 - protein, 165 aa, Neisseria meningitidis
MNSLPIADLLVSAVIAACIVLSAMRGVIAEAGSMAAWVVSFFFAKLFAASFADLAFASFQPRLFALALSFISLFVIACLIQKMLRSLLTSAVSAVGLGFANRILGGVFGALKGVLIVTLLVMLASKTDLPDTEEWRQSYTLPFFVSLSEAVLNHSGGTAETPEDD

SEQ ID NO: 41068 - DNA, 498 bp, Neisseria meningitidis
atgaataacctccccgttgccgacctcctcgtctccgccatcatcgccgcctgcatcgtgctatccgcgatgcgcggcgtgattgcggaggctggctcaatggcggcatgggtggttgccttttttttcgccaaactctttgccgcacccttcgccgacatcgcctttgcatcgttccaaccccgcctgtttgcattggctctgtcgttcatttccctattcgtcattgcctgtctgatccagaaaatactccgctcgctgctgaccggggcagtttcggcggtcggtttgggctttgccaaccgcattttgggcggcgtattcggtgcattgaaaggcattttgattattaccctgctggtcatgctcgcttcaaaaaccgacctgcccgataccgaagaatggcggcaatcttacacactgccgtttttcgtatcgctttccgaagccgtgttgaaccatagcggcggcacggcggaaactccggaagacgattga

SEQ ID NO: 41069 - protein, 165 aa, Neisseria meningitidis
MNNLPVADLLVSAIIAACIVLSAMRGVIAEAGSMAAWVVAFFFAKLFAAPFADIAFASFQPRLFALALSFISLFVIACLIQKILRSLLTGAVSAVGLGFANRILGGVFGALKGILIITLLVMLASKTDLPDTEEWRQSYTLPFFVSLSEAVLNHSGGTAETPEDD

SEQ ID NO: 41070 - DNA, 663 bp, Neisseria gonorrhoeae
atgacgaagggcagttcggcgatgtccagcccacgcgcggcgatatcggtggcgacgaggacgcgcaggctgccgtctttgaaggcgttgagtgtttcgagcctgctttgttgggaacggtcgccgtgtatcgcctgtgcggacaggttgcggcgcaccagttcgcgcgttacgcggtcgacgctttgtttggttttgcaaaagacgataacttggttcatatgcagatcgacaatcagccgttcgagcaggttgcgcttttggaaggtatcgacggcgatgatgtgttgttcgacgttggcgttggtggtgttttgggcggcaacctcgacggtttcgggcgcgttcatgaagtcttgcgccagtttgcgtatcggtgcggagaaggtggcggaaaagagcagggtttggcgttggcggggcagcatctgcatgattttgcggatgtcgtcgataaaccccatatccaacatgcggtctgcttcgtccagaacgacgatttcggctttgtttaaactgatgtttttctgtttcacatggtcgagcagccgtccgacggtggcgacgactatttcgcagccggcacgcaggtcggcggtttgtttgtccatgttgacaccgccgaagaggacggtatgccgcagcggcaggtttttaatgtag

SEQ ID NO: 41071 - protein, 220 aa, Neisseria gonorrhoeae
MTKGSSAMSSPRAAISVATRTRRLPSLKALSVSSLLCWERSPCIACADRLRRTSSRVTRSTLCLVLQKTITWFICRSTISRSSRLRFWKVSTAMMCCSTLALVVFWAATSTVSGAFMKSCASLRIGAEKVAEKSRVWRWRGSICMILRMSSINPISNMRSASSRTTISALFKLMFFCFTWSSSRPTVATTISQPARRSAVCLSMLTPPKRTVCRSGRFLM

SEQ ID NO: 41072 - DNA, 663 bp, Neisseria meningitidis
atgacgaagggcagttcggcaatgtccagcccgcgcgcggcgatgtcggtggcgacgaggacgcgcaggttgccgtctttgaaggcgttgagtgtttcgagccggctttgttgggaacggtcgccgtgtatcgcctgtgcggacaggttgcggcgcaccagttcgcgcgttacgcggtcgacgctttgtttggttttgcagaacacgatgacctggttcatatgcaaatcgacaatcagccgttcgagcaggttgcgcttctgaatggtatcgacggcgatgatgtgctgctcgacgttggcgttggtggtgttttgcgcggcgacttcgacggtttcgggcgcgttcatgaagtcttgcgccagtttgcgtatcggggcggagaaggtggcggaaaagagcagggtttggcgttggcggggcagcatctgcatgattttgcggatgtcgtcgataaaacccatatccagcatacggtcggcttcgtccaaaacgacgatttcgactttgttcaaatggatgtttttctgtttcacgtggtcgagcagccgtccgacggtggcgacgacgatttcgcagccggcacgcaggtcggcggtctgtttgtccatattcataccgccgaacaagacggtgtggcgcagcggcaggtttttgatgtag

SEQ ID NO: 41073 - protein, 219 aa, Neisseria meningitidis
MTKGSSAMSSPRAAMSVATRTRRLPSLKALSVSSRLCWERSPCIACADRLRRTSSRVTRSTLCLVLQNTMTWFICKSTISRSSRLRFMVSTAMMCCSTLALVVFCAATSTVSGAFMKSCASLRIGAEKVAEKSRVWRWRGSICMILRMSSIKPISSIRSASSKTTISTLFKWMFFCFTWSSSRPTVATTISQPARRSAVCLSIFIPPNKTVWRSGRFLM

SEQ ID NO: 41074 - DNA, 663 bp, Neisseria meningitidis
atgacgaagggcagttcggcaatatccagcccccgcgcggcgatatcggtggcgacgaggacgcgcaggttgccgtctttgaaggcgttgagtgtttcgagccggctttgttgggaacggtcgccgtgtatcgcctgtgcggacaggttgcggcgcaccagttcgcgcgttacgcggtcgacgctttgtttggttttgcagaacacgatgacctggttcatatgcaaatcgacaatcagccgttcgagcaggttgcgcttctgaatggtatcgacggcgatgatgtgctgctcgacgttggcgttggtggtgtcttgcgcggcgacttcgacggtttcgggcgcgttcatgaagtcttgcgccagtttgcgtatcggggcggagaaggtggcggaaaagagcagggtttggcgttggcggggcagcatctgcatgattttgcggatgtcgtcgataaaacccatatccagcatacggtcggcttcgtccaaaacgacgatttcgactttgttcaaatggatgtttttctgtttcacgtggtcgagcagccgtccgacggtggcgacgacgatttcgcagccggcacgcaggtcggcggtctgtttgtccatattcataccgccgaacaagacggtgtggcgcagcggcaggtttttgatgtag

SEQ ID NO: 41075 - protein, 219 aa, Neisseria meningitidis
MTKGSSAISSPRAAISVATRTRRLPSLKALSVSSRLCWERSPCIACADRLRRTSSRVTRSTLCLVLQNTMTWFICKSTISRSSRLRFMVSTAMMCCSTLALVVSCAATSTVSGAFMKSCASLRIGAEKVAEKSRVWRWRGSICMILRMSSIKPISSIRSASSKTTISTLFKWMFFCFTWSSSRPTVATTISQPARRSAVCLSIFIPPNKTVWRSGRFLM

SEQ ID NO: 41076 - DNA, 786 bp, Neisseria gonorrhoeae
atgacgacgccgatggcaatcagtgcgtcaaatttttcggaagaggcaaagttcatcagcgcgatggggatttcaagcgcgccgggtacggtggcgacggtgatgttttcgtctgctacgcccaattcttggagggtgcggcagcagactttgagcatttggctgccgatttcgttggtgaagcgtgcctgtacgatgccgatgcggaggtgtttgccgtcgaggttgggggcgatggtgttcattgggtgtcctttggtattcggggtttcggaatgccgtctgaaggtttcagtcttgcggctgccagtcggcaacggtttggaatgtgccgtcttcggcaagctcccacgcgctgccttcgggttgggaaagcagtgcggcggtttcagggttggttttggtgatgtcggcgaggctgacgatgctgaagttgtcggggtcgtcggtgtattcgtcggtttcgtcgccgctgaagaaacgccagccgctgtcgttttcaaaaacgggggcttcgcggtaaaggaagccgacgggccggttttgtttggcgacggtgttggtggcgatgcagcggtcgagtgccgaggaaagtgcttgtgcaaatgcgttcattgcgggaatacgttggggggggggaaacttgcggattttaccacgattcccgcgttgtcggcagacggcggcggtttggtggtacaatgtgcgccgtttgcagccttaaggtgtttctgtatttttggagtatggaaacgcattcgggctgttttttgcggaagacggtaa

SEQ ID NO: 41077 - protein, 261 aa, Neisseria gonorrhoeae
MTTPMAISASNFSEEAKFISAMGISSAPGTVATVMFSSATPNSWRVRQQTLSIWLPISLVKRACTMPMRRCLPSRLGAMVFIGCPLVFGVSECRLKVSVLRLPVGNGLECAVFGKLPRAAFGLGKQCGGFRVGFGDVGEADDAEVVGVVGVFVGFVAAEETPAAVVFKNGGFAVKEADGPVLFGDGVGGDAAVECRGKCLCKCVHCGNTLGGGKLADFTTIPALSADGGGLVVQCAPFAALRCFCIFGVWKRIRAVFCGRR

SEQ ID NO: 41078 - DNA, 782 bp, Neisseria meningitidis
atgacgacgccgatggcaatcagtgcgtcaaacttttcggaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgggtgtcctttggtattcggagtttcggaatgccgtctgaaggtttcagtcttgcggctgccagtcggcgacggtttggaatgtgccgtcttcggcaagctcccatgcgctgccttcgggttgggagagcagtgcggcggtttcagggttggttttggcgatgtcggcgaggctgacgatgctgaagttgtccggatcgtcggtgtattcgtcggtctcgtcgccgctgaagaaacgccagccgctgtcgttttcaaaaacgggggcttcgcggtagaggaagccgacgggccggttttgtttggcgacggtgttggtggcgatacagcggtcgagtgccgaggaaagtgcttgtgcaaatgcgttcattacgggaatacgttgggggaaaacttacggattttaccacgattcgtgcgttgtcggcagacggcggcggtttggtggtacaatgtgcgccgtttgcagccttaaggtgtttctgtatttttggagtatggaaacgcattcgggctgttttttgcggaagacggtaa

SEQ ID NO: 41079 - protein, 260 aa, Neisseria meningitidis
  misc_feature (212)..(212): Xaa can be any naturally occurring amino acid
MTTPMAISASNFSEEAKFISAMGISSAPGTVATVMFSSATPNSWRVRQQTLSISLPISLVKRACTMPMRRCLPSRLGAMVFIGCPLVFGVSECRLKVSVLRLPVGDGLECAVFGKLPCAAFGLGEQCGGFRVGFGDVGEADDAEVVRIVGVFVGLVAAEETPAAVVFKNGGFAVEEADGPVLFGDGVGGDTAVECRGKCLCKCVHYGNTLGXKLTDFTTIRALSADGGGLVVQCAPFAALRCFCIFGVWKRIRAVFCGRR

SEQ ID NO: 41080 - DNA, 782 bp, Neisseria meningitidis
ataacgacgccgatggcaatcagtgcgtcaaatttttcagaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgagtgtcctttggtattcggaggtttcggaatgccgtctgaagggtcagtccttaggttgccagtcggcgacggtttggaatgtgccgtcttctgccaattcccacgcgctgccttcaggttgggagagcagtgcggcggtttcagggttggttttggtgatatcggcgaggctgacgatgctgaagttgtccgggtcgtcggtgtattcgtcggtctcgtcgccgctgaagaaacgccagccgctgtcgttttcaaaaacgggggcttcgcggtagaggaagccgacgggctggttttgtttggcgacggtgttggtggcgatgcagcggtcgagtgccgaggaaagtgcttgtgcaaatgcgttcattgcgggaatacgttgggggaaaacttgcggattttaccacgattcttgcgttgtcggcagacggcggcggtttggtggtacaatgtgcgccgtttgcagccttaaggtgtttctgtatttttggagtatggaaacgcattcgggctgttttttgcggaagacggtaa

SEQ ID NO: 41081 - protein, 260 aa, Neisseria meningitidis
  misc_feature (210)..(210): Xaa can be any naturally occurring amino acid
ITTPMAISASNFSEEAKFISAMGISSAPGTVATVMFSSATPNSWRVRQQTLSISLPISLVKRACTMPMRRCLPSRLGAMVFIECPLVFGGFGMPSEGSVLRLPVGDGLECAVFCQFPRAAFRLGEQCGGFRVGFGDIGEADDAEVVRVVGVFVGLVAAEETPAAVVFKNGGFAVEEADGLVLFGDGVGGDAAVECRGKCLCKCVHCGNTXGGKLADFTTILALSADGGGLVVQCAPFAALRCFCIFGVWKRIRAVFCGRR

SEQ ID NO: 41082 - DNA, 402 bp, Neisseria gonorrhoeae
atgcgcgatttcgccgtatgggtgccttacggggaacggcggaaaaattgggacataaggtattgcctcccgcaccttattcgcctgagcccaacccgattgagaaagtgtgggcgaatattaagcggtatctgcgaaccgttttgtctgattacgcccgatttgacgatgcactactgtcctattttgattttaattgactatatttgtgtgaatgatgaaataaaaatgccgtctgaacccgattggattcagacggcattttgtatggcaggatttattcgctttccaactgaccgacccattctgacaaggcagtcaggcgttgttcggatttcgccacgaacgggttttcggtatcccacgcgtagcctgccaaaatcgaagaaagcatacggctga

SEQ ID NO: 41083 - protein, 133 aa, Neisseria gonorrhoeae
MRDFAVWVPYGERRKNWDIRYCLPHLIRLSPTRLRKCGRILSGICEPFCLITPDLTMHYCPILILIDYICVNDEIKMPSEPDWIQTAFCMAGFIRFPTDRPILTRQSGVVRISPRTGFRYPTRSLPKSKKAYG

SEQ ID NO: 41084 - DNA, 390 bp, Neisseria meningitidis
atgcgtgatttcaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgactatgaaatggcaatgccgtctgaacccgattggattcagacggcattttgtatggcgtacggatttattcggtttccaactgaccgacccattcggacaaggcagtcaggcgttgttcggatttcgccacgaacgggttttcggtatcccacgcgtagcctgccaaaatcgaagaaagcatacggctga

SEQ ID NO: 41085 - protein, 129 aa, Neisseria meningitidis
MRDFTVWVSYGKWRKNWDIRYCLLHLIHLSSTRLRKCGRILSGICEPFCLITPDLTMHYCPILILIDYEMAMPSEPDWIQTAFCMAYGFIRFPTDRPIRTRQSGVVRISPRTGFRYPTRSLPKSKKAYG

SEQ ID NO: 41086 - DNA, 330 bp, Neisseria meningitidis
atgcgcgattttaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgaatattatattcggtttccaactgaccgacccattctgacaaggccgacaggcgttgttcggatttcgccacgaacgggttttcggtatcccacgcgtagcctgccaaaatcgaagaaagcatacggctga

SEQ ID NO: 41087 - protein, 109 aa, Neisseria meningitidis
MRDFTVWVSYGKWRKNWDIRYCLLHLIHLSSTRLRKCGRILSGICEPFCLITPDLTMHYCPILILIEYYIRFPTDRPILTRPTGVVRISPRTGFRYPTRSLPKSKKAYG

SEQ ID NO: 41088 - DNA, 441 bp, Neisseria gonorrhoeae
atgattaaggaaaccctaatgcgcccaatcttcctatctttcgttttactccctattttgataaccgcctgcagcacaccggacaagtctgcccgatgggaaaatatcggcacaatctcaaacggcaatattcatacatatattaataaagacagtgtgagaaaaaacggaaatctgatgattttccaagataaaaaagttgttaccaatctgaaacaagaacgttttgccaacacccccgcatacaagactgccattgccgagtgggaaatccactgcaacaacaaaacataccgcttaagttcgctacagttatttgatacaaaaaacacggaaatttccacacaaaactacacagcctcttccctccgcccgatgagcatcctgtccgggacattaactgaaaaacaatatgaaaccgtatgcgggaaaaaactctga

SEQ ID NO: 41089 - protein, 146 aa, Neisseria gonorrhoeae
MIKETLMRPIFLSFVLLPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 41090 - DNA, 441 bp, Neisseria meningitidis
atgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacagttgtttgatacaaaaaacacggaaatttccacacaaaactacacagcctcttccctccgcccgatgagcatcctgtccgggacattaaccgaaaaacaatatgaaaccgtatgcggaaaaaaactctga

SEQ ID NO: 41091 - protein, 146 aa, Neisseria meningitidis
MIKETLMRPIFLSFVLFPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 41092 - DNA, 441 bp, Neisseria meningitidis
  misc_feature (188)..(188): n is a, c, g, or t
  misc_feature (232)..(232): n is a, c, g, or t
  misc_feature (351)..(351): n is a, c, g, or t
atgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccnagataaaaaagttgttaccaatctaaaacaagaacgttttgccnacacccccgcatacaagactgccattgccgagtgggaaatccactgcaacaacaaaacataccgcttaagttcgctacaattgtttgatacaaaaaacacggaaatttccacacaaaantacacagcctcttccctccgcccgatgagcatcctgtccgggacattaaccgaaaaacaatatgaaaccgtatgcggaaaaaaactctga

SEQ ID NO: 41093 - protein, 146 aa, Neisseria meningitidis
  misc_feature (63)..(63): Xaa can be any naturally occurring amino acid
  misc_feature (78)..(78): Xaa can be any naturally occurring amino acid
  misc_feature (117)..(117): Xaa can be any naturally occurring amino acid
MIKETLMRPIFLSFVLFPILITACSTPDKSARWENIGTISNGNIHTYINKDSVRKNGNLMIFXDKKVVTNLKQERFAXTPAYKTAIAEWEIHCNNKTYRLSSLQLFDTKNTEISTQXYTASSLRPMSILSGTLTEKQYETVCGKKL

SEQ ID NO: 41094 - DNA, 519 bp, Neisseria gonorrhoeae
atgcgccttttccccatcgccgccgccctgacgcttgccgcctgcggtactgtgcaaagcacacaatatttcgtgttgcccgacagccgctacatccgtcctgcaacgcaaggcggcgaaaccgccgtcgaagtccgtcttgccgaaccgctcaaacgcggcggactggtctatcaaaccgacccctaccgcatcaacaccgcacaaaaccatgtttgggcagacaccttggacgatatgctcgaagcggcgttgagcaatgcattcaaccgtttggacagcacacgcacctttgttcctgcctcacgcagcggcagtaccgacaaatggacggtctatatcgacgcattccaaggcagctacacgggcaaaaccctcatcagcggctacgccgtcctacccgacggtacgaacagacccttccatatcgaaaccgaacagcagggtgacggctacgccgccatgaccgccgcactcgaacagggactgaaacaggcggcgcaacagatggtcgagtaa

SEQ ID NO: 41095 - protein, 172 aa, Neisseria gonorrhoeae
MRLFPIAAALTLAACGTVQSTQYFVLPDSRYIRPATQGGETAVEVRLAEPLKRGGLVYQTDPYRINTAQNHVWADTLDDMLEAALSNAFNRLDSTRTFVPASRSGSTDKWTVYIDAFQGSYTGKTLISGYAVLPDGTNRPFHIETEQQGDGYAAMTAALEQGLKQAAQQMVE

SEQ ID NO: 41096 - DNA, 519 bp, Neisseria meningitidis
atgcgccttttcccgattgccgccgccctgtcgcttgccgcctgcggtactgtgcaaagcacacaatatttcgtgttgcccgacagccgctacatccgtcctgcaacgcaaggcggcgaaactgccgtcgaagtccgtcttgccgaaccgctcaaacgcggcggactggtctatcaaaccgacccctaccgcctcaacaccgcacaaaaccacgtctgggcagacaccttggacgatatgctcgaagcggcgttgagcaatgcattcaaccgtttggacagcacacgcatctttgttcctgcctcacgcagcggcagtaccgaaaaatggacggtctatatcgacgcattccaaggcagctacacgggcaaaaccctcatcagcggctacgccgtcctacccgacggtacgaacagacccttccatatcgaaaccgaacagcagggtgacggctacgccgcgatgaccgccgcactcgaacagggactgaaacaggcggcgcaacagatggtcgagtaa

SEQ ID NO: 41097 - protein, 172 aa, Neisseria meningitidis
MRLFPIAAALSLAACGTVQSTQYFVLPDSRYIRPATQGGETAVEVRLAEPLKRGGLVYQTDPYRLNTAQNHVWADTLDDMLEAALSNAFNRLDSTRIFVPASRSGSTEKWTVYIDAFQGSYTGKTLISGYAVLPDGTNRPFHIETEQQGDGYAAMTAALEQGLKQAAQQMVE

SEQ ID NO: 41098 - DNA, 519 bp, Neisseria meningitidis
atgcgcctcttcccgattgccgccgccctgacgcttgccgcctgcggtactgtgcaaagcacacaatatttcgtgttgcccgacagccgctacatccgtcctgcaacgcaaggcggcgaaactgccgtcgaagtccgtcttgccgaaccgctcaaacgcggcggactggtctatcaaaccgacccctaccgcctcaacaccgcacaaaaccacgtctgggcagacaccttggacgatatgctcgaagcggcgttgagcaatgcattcaaccgtttggacagcacacgcatctttgttcctgcctcacgcagcggcagtaccgaaaaatggacggtctatatcgacgcattccaaggcagctacacgggcaaaaccctcatcagcggctacgccgtcctacccgacggtacgaacagacccttccatatcgaaaccgaacagcagggtgacggctacgccgccatgaccgccgcactcgaacagggactgaaacaggcggcgcaacagatggtcgagtaa

SEQ ID NO: 41099 - protein, 172 aa, Neisseria meningitidis
MRLFPIAAALTLAACGTVQSTQYFVLPDSRYIRPATQGGETAVEVRLAEPLKRGGLVYQTDPYRLNTAQNHVWADTLDDMLEAALSNAFNRLDSTRIFVPASRSGSTEKWTVYIDAFQGSYTGKTLISGYAVLPDGTNRPFHIETEQQGDGYAAMTAALEQGLKQAAQQMVE

SEQ ID NO: 41100 - DNA, 1074 bp, Neisseria gonorrhoeae
ttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgccggccgcctgttcgcccgaacctgccgccgaaaaaactgtatccgccgcatcccaagccgcatccacacctgtcgccacgctgaccgtgccgaccgcgcggggcgatgccgttgtgccgaagaatcccgaacgcgtcgccgtgtacgactgggcggcgttggatacgctgaccgagccgggcgtgaatgtgggcgcaaccaccgcgccggtgcgcgtggactatttgcagcctgcatttgacaaggcggcaacggtggggacgctgtttgagcccgattgcgaatccctgcaccgccacaatccgcagtttgtcattaccggcgggccgggtgcggaagcgtatgaacagttggcgaaaaacgcgaccaccatagatttgacggtggacaacggcaatatccgcaccagcggcgagaagcagatggagaccctgtcgcggattttcggtaaggaagcgcgcgtggcggaattgaatgcgcagattgacgcgctgttcgcccaaaagcgcgaagccgccaaaggcaaaggacgcgggctggtgctgtcggttacaggcaacaaggtgtccgccttcggcacgcaatcgcggttggcaagttggatacacggcgacatcggcctgccgcccgtggacgaatctttacgcaacgaagggcacgggcagcccgtttccttcgaatacatcaaagagaaaaaccccggctggattttcatcatcgaccgcaccgccgccatcgggcaggaagggccggctgccgtggaagtgttggataacgcgctggtatgcggcacgaacgcttggaagcgcaagcaaatcatcgtcatgcctgccgcgaactacattgtcgcgggcggcgcgcggcagttgatacaggcggcggaacagttgaaggcggcgtttgaaaaggcagaacccgttgcggcgcagtag

SEQ ID NO: 41101 - protein, 357 aa, Neisseria gonorrhoeae
LFCRIGNFAFCGVVSAGCLLNNKHSYSYAKEPHTVKPRFYWAACAVLPAACSPEPAAEKTVSAASQAASTPVATLTVPTARGDAVVPKNPERVAVYDWAALDTLTEPGVNVGATTAPVRVDYLQPAFDKAATVGTLFEPDCESLHRHNPQFVITGGPGAEAYEQLAKNATTIDLTVDNGNIRTSGEKQMETLSRIFGKEARVAELNAQIDALFAQKREAAKGKGRGLVLSVTGNKVSAFGTQSRLASWIHGDIGLPPVDESLRNEGHGQPVSFEYIKEKNPGWIFIIDRTAAIGQEGPAAVEVLDNALVCGTNAWKRKQIIVMPAANYIVAGGARQLIQAAEQLKAAFEKAEPVAAQ

SEQ ID NO: 41102 - DNA, 1068 bp, Neisseria meningitidis
ttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtag

SEQ ID NO: 41103 - protein, 355 aa, Neisseria meningitidis
LFCRIGNFAFCGVVSAGCLLNNKHSYSYAKEPHTVKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGARQLIQAAEQLKAAFKKAEPVAAGKK

SEQ ID NO: 41104 - DNA, 1068 bp, Neisseria meningitidis
ttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacactgaccgtgccgaccgcgcggggcgatgccgttgtgccgaagaatcccgaacgcgtcgccgtgtacgactgggcggcgttggatacgctgaccgaattgggtgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttggcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggctcgcggcagttgattcaggcggcggagcagttgaaggaggcgtttgaaaaggcagaacccgttgcggcggggaaagagtag

SEQ ID NO: 41105 - protein, 355 aa, Neisseria meningitidis
LFCRIGNFAFCGVVSAGCLLNNKHSYSYAKEPHTVKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGSRQLIQAAEQLKEAFEKAEPVAAGKE

SEQ ID NO: 41106 - DNA, 396 bp, Neisseria gonorrhoeae
aatttctcctgccgcgccgatgatgtttttgacgatatctgcagtgccgttgaaggcttcggcggcattgcccgatctgtccagctcggggctgtatcgggtggcgcgtttgaatccgtcgcctactccttgcgtcagcatagcgccggcattgtggaaacggtcggcaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctgaatccgtcaacgggactaccggcttcgtcagaatcggaatgtga

SEQ ID NO: 41107 - protein, 131 aa, Neisseria gonorrhoeae
NFSCRADDVFDDICSAVEGFGGIARSVQLGAVSGGAFESVAYSLRQHSAGIVETVGKPLSGAAVVGQVEADILGNAFYVVAVYIPRAFGSGIAAALWPVIAVGGMVFVSVPMDAVKAESVNGTTGFVRIGM

SEQ ID NO: 41108 - DNA, 492 bp, Neisseria meningitidis
  misc_feature (85)..(96): n is a, c, g, or t
atgatgttgaaaaaattcgtactcggcggtattgccgcattggttttggcggcctgcggcggttcggaaggcggcagcggagcgnnnnnnnnnnnnaatttctcctgcagcgccgatgatgtttttaacgatatctgcagtgccgttgaaggcttcggcggcattgcccgatctgtccagctcggggctgtatcgggtggcgcgtttgaatccgtcgcctactccttgcgtcagcatactaccggcattgtggaaacggtcggcaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctaaatccgtcaacgggactaccggcttcatcagaatcggaatgtga

SEQ ID NO: 41109 - protein, 163 aa, Neisseria meningitidis
  misc_feature (29)..(32): Xaa can be any naturally occurring amino acid
MMLKKFVLGGIAALVLAACGGSEGGSGAXXXXNFSCSADDVFNDICSAVEGFGGIARSVQLGAVSGGAFESVAYSLRQHTTGIVETVGKPLSGAAVVGQVEADILGNAFYVVAVYIPRAFGSGIAAALWPVIAVGGMVFVSVPMDAVKAKSVNGTTGFIRIGM

SEQ ID NO: 41110 - DNA, 396 bp, Neisseria meningitidis
aatttctcctgccgcgccgatgatgtttttgacgatatctgcagtgccgttgaaagcttcggcggcattgcccgatctgtccagctcggggctgtatcgggtggcgcgtttgaatccgtcgcctactccttgcgtcagcatactaccggtattgtggaaacggtcgacaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctgaatccgtcaacgggactaccggcttcatcagaatcggaatgtga

SEQ ID NO: 41111 - protein, 131 aa, Neisseria meningitidis
NFSCRADDVFDDICSAVESFGGIARSVQLGAVSGGAFESVAYSLRQHTTGIVETVDKPLSGAAVVGQVEADILGNAFYVVAVYIPRAFGSGIAAALWPVIAVGGMVFVSVPMDAVKAESVNGTTGFIRIGM

SEQ ID NO: 41112 - DNA, 705 bp, Neisseria gonorrhoeae
atgaaatccagacacctcgccctcgccctcggcgttgccgccctgttcgcccttgccgcgtgcgacagcaaagtccaaaccagcgtccccgccgacagcgcgcctgccgcttcggcagccgccgccccggcaggactggtcgaagggcaaaactacaccgtccttgccaacccgattccccaacagcaggcaggcaaggttgaagtgcttgagtttttcggctatttttgtccgcactgcgcccgcctcgaacctgttttgagcaaacacgccaagtcttttaaagacgatatgtacctgcgtaccgaacacgtcgtctggcagaaagaaatgctgccgctggcacgcctcgccgccgccgtcgatatggctgccgccgaaagcaaagatgtggcgaacagccatattttcgatgcgatggtcaaccaaaaaatcaagctgcaagagccggaagtcctcaaaaaatggctgggcgaacaaaccgcctttgacggcaaaaaagtccttgccgcctacgaatcccccgaaagtcaggcgcgcgccggcaaaatgcaggagctgaccgaaaccttccaaatcgacggtacgcccacggttatcgtcggcggcaaatataaagtcgaatttgccgactgggagtccggtatgaacaccatcgaccttttggcggacaaagtacgtgaagaacaaaaagccgcgcagtag

SEQ ID NO: 41113 - protein, 234 aa, Neisseria gonorrhoeae
MKSRHLALALGVAALFALAACDSKVQTSVPADSAPAASAAAAPAGLVEGQNYTVLANPIPQQQAGKVEVLEFFGYFCPHCARLEPVLSKHAKSFKDDMYLRTEHVVWQKEMLPLARLAAAVDMAAAESKDVANSHIFDAMVNQKIKLQEPEVLKKWLGEQTAFDGKKVLAAYESPESQARAGKMQELTETFQIDGTPTVIVGGKYKVEFADWESGMNTIDLLADKVREEQKAAQ

SEQ ID NO: 41114 - DNA, 699 bp, Neisseria meningitidis
atgaaatccagacaccttgccctcggcgttgccgccctgttcgcccttgccgcgtgcgacagcaaagtccaaaccagcgtccccgccgacagcgcgcctgccgcttcggcagccgccgccccggcagggctggtcgaagggcaaaactataccgtccttgccaacccgattccccaacagcaggcaggcaaagtcgaagtccttgagtttttcggctatttctgtccgcactgcgcccacctcgaacctgttttaagcaaacacgccaagtcttttaaagacgatatgtacctgcgtaccgaacacgtcgtctggcagaaagaaatgctgacgctggcacgcctcgccgccgccgtcgatatggctgccgccgacagcaaagatgtggcgaacagccatattttcgatgcgatggtcaaccaaaaaatcaagctgcaaaatccggaagtcctcaaaaaatggctgggcgaacaaaccgcctttgacggcaaaaaagtccttgccgcctacgagtcccccgaaagccaggcgcgcgccgacaaaatgcaggagctgaccgaaaccttccaaatcgacggtacgcccacggttatcgtcggcggtaaatataaagttgaatttgccgactgggagtccggtatgaacaccatcgaccttttggcggacaaagtacgcgaagaacaaaaagccgcgcagtaa

SEQ ID NO: 41115 - protein, 232 aa, Neisseria meningitidis
MKSRHLALGVAALFALAACDSKVQTSVPADSAPAASAAAAPAGLVEGQNYTVLANPIPQQQAGKVEVLEFFGYFCPHCAHLEPVLSKHAKSFKDDMYLRTEHVVWQKEMLTLARLAAAVDMAAADSKDVANSHIFDAMVNQKIKLQNPEVLKKWLGEQTAFDGKKVLAAYESPESQARADKMQELTETFQIDGTPTVIVGGKYKVEFADWESGMNTIDLLADKVREEQKAAQ

SEQ ID NO: 41116 - DNA, 699 bp, Neisseria meningitidis
atgaaatccaaacacctcgccctcggcgttgccgccctgttcgcacttgccgcgtgcgacagcaaagtccaaaccagcgtccccgccgacagcgcgcctgccgcttcggcagccgccgccccggcagggctggtcgaagggcaaaactatactgtccttgccaacccgattccccaacagcaggcaggcaaagtcgaagtccttgagtttttcggctatttctgtccgcactgcgcccacctcgaacctgttttaagcaaacacgccaagtcttttaaagacgatatgtacctgcgtaccgaacacgtcgtctggcagaaagaaatgctgacgctcgcacgcctcgccgccgccgtcgatatggctgccgccgacagcaaagatgtggcgaacagccatattttcgatgcgatggtcaaccaaaaaatcaagctgcaagagccggaagtcctcaaaaaatggctgggcgaacaaaccgcctttgacggcaaaaaagtccttgccgcttacgaatctcccgaaagccaggcgcgcgccgacaaaatgcaggagctgaccgaaaccttccaaatcgacggtacgcccacggttatcgtcggcggcaaatataaagtcgaatttgccgactgggagtccggtatgaacaccatcgaccttttggcggacaaagtacgcgaagaacaaaaagccgcgcactaa

SEQ ID NO: 41117 - protein, 232 aa, Neisseria meningitidis
MKSKHLALGVAALFALAACDSKVQTSVPADSAPAASAAAAPAGLVEGQNYTVLANPIPQQQAGKVEVLEFFGYFCPHCAHLEPVLSKHAKSFKDDMYLRTEHVVWQKEMLTLARLAAAVDMAAADSKDVANSHIFDAMVNQKIKLQEPEVLKKWLGEQTAFDGKKVLAAYESPESQARADKMQELTETFQIDGTPTVIVGGKYKVEFADWESGMNTIDLLADKVREEQKAAH

SEQ ID NO: 41118 - DNA, 420 bp, Neisseria gonorrhoeae
gtgctacactagacatcccgatttgcacagaaaggttctcccgtgaacaaaaccctcatcctcgccctttccgccctgttcagcctgaccgcgtgcagcgtcgaacgcgtctcgctgtttccctcctacaaactcaaaatcatccaaggcaacgaactcgaaccgcgcgccgttgccgccctgcgccccggcatgaccaaagaccaagtcctgctcctgctcggcagccccatactgcgcgacgctttccataccgaccgctgggactataccttcaacacctcccgcaacggcatcatcaaagaacgcagcaacctgaccgtctattttgaaaacggcgtactcgtccgcaccgaaggcgacgccctccaaaatgccgccgaagccctccgcgcgaaacaaaacgcagacaaacaataa

SEQ ID NO: 41119 - protein, 138 aa, Neisseria gonorrhoeae
VLHTSRFAQKGSPVNKTLILALSALFSLTACSVERVSLFPSYKLKIIQGNELEPRAVAALRPGMTKDQVLLLLGSPILRDAFHTDRWDYTFNTSRNGIIKERSNLTVYFENGVLVRTEGDALQNAAEALRAKQNADKQ

SEQ ID NO: 41120 - DNA, 420 bp, Neisseria meningitidis
gtgttacactacccatcccgatttgcacagaaaggcatttccgtgaacaaaaccctcatcctcgccctttccgccctcctcggccttgccgcgtgcagtgccgaacgcgtttcactgttcccctcgtacaaactcaaaatcatacagggcaacgaactcgaaccgcgcgccgttgccgccctccgccccggcatgaccaaagaccaagtcctgctcctgctcggcagccccatactgcgcgacgcattccataccgaccgctgggactataccttcaacacctcccgcaacggcatcatcaaagaacgcagcaatctgaccgtctattttgaaaacggcgtactcgtccgcaccgaaggcgacgtcctgcaaaacgctgccgaagccctcaaagaccgccaaaacacagacaaaccataa

SEQ ID NO: 41121 - protein, 139 aa, Neisseria meningitidis
VLHYPSRFAQKGISVNKTLILALSALLGLAACSAERVSLFPSYKLKIIQGNELEPRAVAALRPGMTKDQVLLLLGSPILRDAFHTDRWDYTFNTSRNGIIKERSNLTVYFENGVLVRTEGDVLQNAAEALKDRQNTDKP

SEQ ID NO: 41122 - DNA, 420 bp, Neisseria meningitidis
gtgttacactacccatcccgatttgcacagaaaggcatttccgtgaacaaaaccctcatcctcgccctttccgccctcctcggccttgccgcgtgcagcgtcgaacgcgtttcactgttcccctcgtacaaactcaaaatcatacagggcaacgaactcgaacctcgcgccgtcgcctccctccgccccggtatgaccaaagaccaagtcctgctcctgctcggcagccccatactgcgcgacgcattccataccgaccgctgggactataccttcaacacctcccgcaacggcatcatcaaagaccgaagcaatctgaccgtctattttgaaaacggcgtgctcgtccgcaccgaaggcaacgccctgcaaaatgccgccgaagccctccgcgtaaaacaaaacgcagacaaacaataa

SEQ ID NO: 41123 - protein, 139 aa, Neisseria meningitidis
VLHYPSRFAQKGISVNKTLILALSALLGLAACSVERVSLFPSYKLKIIQGNELEPRAVASLRPGMTKDQVLLLLGSPILRDAFHTDRWDYTFNTSRNGIIKDRSNLTVYFENGVLVRTEGNALQNAAEALRVKQNADKQ

SEQ ID NO: 41124 - DNA, 1200 bp, Neisseria gonorrhoeae
tctccgccccttcctccgatgagcggaaaactgatggcggttttgatggcggtactggtcgcgctgatgccgttttccatcgatgcctacctgcccgcgattcccgaaatggcgcagccgctgaacgcggatatccaccgtatcgaatagagtctgagtttgtttatgttcggcacggcgttcgggcaagtggccggcggcgcggtgtccgacatcaaagggcgcaaacccgtcgccctgaccggtttgattgtatattgccttgccgttgccgccatcgtatttgcttcgagtaccgaacagctccttaacctgcgtgcggtacaggcgttcggcgcaggcatggctgtagtcatcgtcggtgcgatggtgcgcgattattattccggacgcaaagccgcgcagatgtttgcccttatcggcatcattctgatggttgtgccgctggccgcacccatggtcggcgcattgttgcagggattgggcggatggcgggcgattttcgttttcttggcggcgtattcgccggtgctgcccggtttggtacagtatttcctgcccaatcccgccgtcggcggcaaaatcggcagggatgtgttcgggctggtggcggggcggttcaagcgcgtattgaaaacccgtgccgcgatgggttatctgttttttcaggcattcagcttcggttcgatgttcgcctttctgaccgaatcttccttcgtgtaccggcagctctaccacgttacgccgcaccggtacgcatgggtgtttgcactcaacatcatcacgatgatgtttttcagccgcgttaccgcgtggcggcttaaaaccggcgcgcatccgcaaagcatcctgctgcgggggattgtcgtccaatttgccgccaacccgtcccaactcgccgccgtgctgtttttcgggttgcccccgttttggctgccggtcgcgtgcgtgatgttttccgtcggtacgcagggcctggtcggtgcggacacgcaggcatgctttatgtcttatttcaaagaagagggcggcagcgcgaacgccgtgtcgggtgtattccggtccttaatcggcgcgggcgtggtcatggcggcaaccgtgatggcggcaaccatgaccgcgtccgcctcttgcggcattgcgcttttgtggctctgctcgcacaaggcgtggaaggaaaacgaaaaaaagcgaatactt

SEQ ID NO: 41125 - protein, 399 aa, Neisseria gonorrhoeae
SPPLPPMSGKLMAVLMAVLVALMPFSIDAYLPAIPEMAQPLNADIHRIESLSLFMFGTAFGQVAGGAVSDIKGRKPVALTGLIVYCLAVAAIVFASSTEQLLNLRAVQAFGAGMAVVIVGAMVRDYYSGRKAAQMFALIGIILMVVPLAAPMVGALLQGLGGWRAIFVFLAAYSPVLPGLVQYFLPNPAVGGKIGRDVFGLVAGRFKRVLKTRAAMGYLFFQAFSFGSMFAFLTESSFVYRQLYHVTPHRYAWVFALNIITMMFFSRVTAWRLKTGAHPQSILLRGIVVQFAANPSQLAAVLFFGLPPFWLPVACVMFSVGTQGLVGADTQACFMSYFKEEGGSANAVSGVFRSLIGAGVVMAATVMAATMTASASCGIALLWLCSHKAWKENEKKRIL

SEQ ID NO: 41126 - DNA, 1380 bp, Neisseria meningitidis
ttgttaatccactatatcgttccggttcgtccggttttgccggggcttttgttgccgcctgtttgtgccggtgtgttaaaattttccgtttccgcgtattgtgttttccgccgccgggcggtttgtttgcgaatcggacgagaatttatgccttctgcccattatcctgaaatgagcgaaaaactgatggcggttttgatggcgatgctggttacgctgatgccgttttccatcgatgcctacctgcccgcgattcccgaaatggcgcaatcgctgaacgcggatgttcaccgcatcgaacagagtttgagtttgtttatgttcggcacggcgttcggacaggtggtcggcggttcggtgtccgacatcaaagggcgcaaacccgtcgccctgaccggtttgattgtatattgccttgccgttgccgccatcgtatttgtttcgagtgccgaacagctcctcaacctgcgcgtcgtgcaggcattcggtgcgggcatgactgtggtcatcgtcggcgcaatggtgcgcgattattattccggacgcaaagccgcccagatgtttgcccttatcggcatcattttgatggttgtgccgctggtcgcacccatggtcggcgcattgttgcagggcttgggtggctggcaggcgatttttgtttttctggcggcgtattcgctggtgctgctcggtttggtacagtatttcctgcccaagcccgccgtcggcggcaaaatcggacgggacgtgttcgggctggtggcggggcggttcaagcgcgtattgaaaacccgtgctgcgatgggttatctgttttttcaggcattcagcttcggttcgatgttcgcctttctgaccgaatcttccttcgtgtaccagcagctctaccgtgttacgcctcatcaatacgcttgggcgtttgcactcaacatcatcacgatgatgtttttcaaccgcgttaccgcgtggcggctcaaaaccggcgtgcatccgcaaagcatcctgctgtgggggattgtcgtccagtttgccgccaacctgtcccaactcgccgccgtgctgtttttcgggttgcccccgttttggctgctggtcgcgtgcgtgatgttttccgtcggtacgcagggcttggtcggtgcaaacacgcaggcgtgttttatgtcctatttcaaagaagagggcggcagcgcaaacgccgtattgggtgtattccaatctttaatcggcgcgggggtgggtatggcggcgaccttcttgcacgacggttcggcaaccgtgatggcggcaacgatgaccgcgtccacctcttgcggcattgcgcttctgtggctctgctcgcatcgtgcgtggaaagaaaacgggcaaagcgaatacctttaa

SEQ ID NO: 41127 - protein, 459 aa, Neisseria meningitidis
LLIHYIVPVRPVLPGLLLPPVCAGVLKFSVSAYCVFRRRAVCLRIGREFMPSAHYPEMSEKLMAVLMAMLVTLMPFSIDAYLPAIPEMAQSLNADVHRIEQSLSLFMFGTAFGQVVGGSVSDIKGRKPVALTGLIVYCLAVAAIVFVSSAEQLLNLRVVQAFGAGMTVVIVGAMVRDYYSGRKAAQMFALIGIILMVVPLVAPMVGALLQGLGGWQAIFVFLAAYSLVLLGLVQYFLPKPAVGGKIGRDVFGLVAGRFKRVLKTRAAMGYLFFQAFSFGSMFAFLTESSFVYQQLYRVTPHQYAWAFALNIITMMFFNRVTAWRLKTGVHPQSILLWGIVVQFAANLSQLAAVLFFGLPPFWLLVACVMFSVGTQGLVGANTQACFMSYFKEEGGSANAVLGVFQSLIGAGVGMAATFLHDGSATVMAATMTASTSCGIALLWLCSHRAWKENGQSEYL

SEQ ID NO: 41128 - DNA, 1380 bp, Neisseria meningitidis
ttgttaatccactatatcgttccggttcgtccggttttgccggggcttttgttgccgcctgtttgtgccggtgtgttaaaattttccgtttccgcgtattgtgttttccgccgccgggcggtttgtttgcgaatcggacgagaatttatgccttctgcccattatcctgaaatgagcgaaaaactgatggcggttttgatggcgatgctggttacgctgatgccgttttccatcgatgcctacctgcccgcgattcccgaaatggcgcagtcgctgaacgcggatgtccaccgcatcgaacagagcctgagtttgtttatgttcggcacggcgttcggacaggtggtcggcggttcggtgtccgacatcaaagggcgcaaacccgtcgcgctgaccggactggccgtctactgccttgccgttgccgccatcgtatttgcttcgagtgccgaacagctcctcaacctgcgcgtcgtgcaggcattcggtgcgggcatgactgtggtcatcgtcggcgcaatggtgcgcgattattattccggacgcaaagccgcccagatgtttgcccttatcggcatcattttgatggttgtgccgctggtcgcacccatggtcggcgcattgttgcagggcttgggtggctggcaggcgatttttgtttttctggcggcgtattcgctggtgctgctcggtttggtacagtatttcctgcccaagcccgccgtcggcggcaaaatcggcagggatgtgttcgggctggtggctgggcggttcaaacgcgtattgaaaacccgtgccgcgatgggttatctgttttttcaggcattcagcttcggttcgatgttcgcctttctgaccgaatcttccttcgtgtaccagcagctctaccacgttacgccgcaccagtacgcttgggcgtttgcactcaacatcatcacgatgatgtttttcaaccgtattaccgcgtggcggctcaaaaccggcgtgcatccgcaaagcatcctgctgtgggggattgtcgtccagtttgccgccaacctgtcccaactcgccgccgtgctgtttttcgggttgcccccgttttggctgctggtcgcgtgcgtgatgttttccgtcggtacgcagggcttggtcggtgcaaacacgcaggcgtgttttatgtcctatttcaaagaagagggcggcagcgcaaacgccgtattgggtgtattccaatctttaatcggcgcgggggtgggtatggcggcgaccttcttgcacgacggttcggcaaccgtgatggcggcaaccatgaccgcgtctacctcttgcggcattgcgcttttgtggctctgctcgcatcgtgcgtggaaagaaaacgggcaaagcgaatacctttaa

SEQ ID NO: 41129 - protein, 459 aa, Neisseria meningitidis
LLIHYIVPVRPVLPGLLLPPVCAGVLKFSVSAYCVFRRRAVCLRIGREFMPSAHYPEMSEKLMAVLMAMLVTLMPFSIDAYLPAIPEMAQSLNADVHRIEQSLSLFMFGTAFGQVVGGSVSDIKGRKPVALTGLAVYCLAVAAIVFASSAEQLLNLRVVQAFGAGMTVVIVGAMVRDYYSGRKAAQMFALIGIILMVVPLVAPMVGALLQGLGGWQAIFVFLAAYSLVLLGLVQYFLPKPAVGGKIGRDVFGLVAGRFKRVLKTRAAMGYLFFQAFSFGSMFAFLTESSFVYQQLYHVTPHQYAWAFALNIITMMFFNRITAWRLKTGVHPQSILLWGIVVQFAANLSQLAAVLFFGLPPFWLLVACVMFSVGTQGLVGANTQACFMSYFKEEGGSANAVLGVFQSLIGAGVGMAATFLHDGSATVMAATMTASTSCGIALLWLCSHRAWKENGQSEYL

SEQ ID NO: 41130 - DNA, 810 bp, Neisseria gonorrhoeae
atgaaaaacaaaacgtcatcacttcccttatggcttgccgcaatcatgctggccgcgcgttccccgagcaaagaagataaaacgaaagaaaacggcgcatccgccgcttcgtcttccgcgtcatcggcttcttcccaaaccgatttgcaaccggccgcatccgcccctgataacgtcaagcaggcagaaagcgcgccactgtgaaattgcaccggcctgcaccccgccgccggcattggcgatctcatacagcaaatcgccgaacacatcgactcggactgtctgtttgccctttcccataacgaactggaaacccgtttcggcttacccggcggcggctatgacaacatacagcggctgctgtttcccgacatccgccctgaagatcccgactaccatcagaaaatcatgctggcaatcgaagacttgcgttacggaacgcgcaccatcagccggcaggcacaagatgccataatggaacaggaacgccgcctccgagaagcgacgctgatgctgacacagggcagtcaaaaaacccgcggacaaggcgaggaaccgaaacgcgcacgttattttgaagtttcggcaacatctgcctatttgaaccggcacaacaacggacttggcggcaatttccaatacatcggccaattgcccggctatctgaaaatgcacggagaaatgcttgaaaaccaatcactcttccggctgtccaaccgtgaacgcaatcccgacaaaccgtttttagacatccattttgacgaaaatggcaaaatcacgcgtattgtcgtttacgaaaaaaatatctat

SEQ ID NO: 41131 - protein, 269 aa, Neisseria gonorrhoeae
MKNKTSSLPLWLAAIMLAARSPSKEDKTKENGASAASSSASSASSQTDLQPAASAPDNVKQAESAPLNCTGLHPAAGIGDLIQQIAEHIDSDCLFALSHNELETRFGLPGGGYDNIQRLLFPDIRPEDPDYHQKIMLAIEDLRYGTRTISRQAQDAIMEQERRLREATLMLTQGSQKTRGQGEEPKRARYFEVSATSAYLNRHNNGLGGNFQYIGQLPGYLKMHGEMLENQSLFRLSNRERNPDKPFLDIHFDENGKITRIVVYEKNIY

SEQ ID NO: 41132 - DNA, 837 bp, Neisseria meningitidis
atgaaaaacaaaacctcatcacttctcttatggcttaccgcaatcatgctgaccgcgtgttctccgagcaaagacgataaaaccaaagaagtcggtgcatccgctgcttcgtcctccgcgtcatcagctccttcccaaaccgatttgcaaccgaccgcatccgcccctgataacgtcaagcaggcagaaagcgcgccgccgtcaaattgcaccagcctgcaccccgccaccggcattgacgatctcatgcagcaaatcgccgaacacattgactcggactgtctgtttgccctttcccatcacgaactggaaacccgtttcggcttacccgacggtggctatgacaacatacagcggctgctgtttcccgacatccgccctgaagatcccgactaccatcagaaaatcatactggcaattgaagacttgcgttacggaaagcgcacgatcagccggcaggcacaaaatgccttgatggaacaggaacgccgcctccgagaagcgacgctgttgctgatacagggcagtcaagaaacccgcggacaaggcgaggagccgaaacgcacgcgttattttgaagtttcggcaacccctgcctattcgagccggcacaacaacggacttggcggcaatttccaatacatcagccaattgcccggctatctgaaaatacacggagaaatgcttgaaaaccaatcactcttccggctgtccaaccgtgaacgcaatcccgacaaaccgtttttagacatccattttgacgaaaatggcaaaatcacgcgtattgtcgtttacgaaaaaaacatctacttcaatccaaacacggggcgaatataa

SEQ ID NO: 41133 - protein, 278 aa, Neisseria meningitidis
MKNKTSSLLLWLTAIMLTACSPSKDDKTKEVGASAASSSASSAPSQTDLQPTASAPDNVKQAESAPPSNCTSLHPATGIDDLMQQIAEHIDSDCLFALSHHELETRFGLPDGGYDNIQRLLFPDIRPEDPDYHQKIILAIEDLRYGKRTISRQAQNALMEQERRLREATLLLIQGSQETRGQGEEPKRTRYFEVSATPAYSSRHNNGLGGNFQYISQLPGYLKIHGEMLENQSLFRLSNRERNPDKPFLDIHFDENGKITRIVVYEKNIYFNPNTGRI

SEQ ID NO: 41134 - DNA, 846 bp, Neisseria meningitidis
atgaaaaacaaaacctcatcacttctcttatggcttgccgcaatgatgctgaccgcgtgttccccgagcaaagaagataaaacgaaagaaaacggcgcatccgccgcctcgtccacggcatccgccgcttcgtcttccgcgccccaaaccgatttgcaaccggccgcatccgcccctgataacgtcaagcaggcagaaagcgtgccgccgtcaaattgcaccgacctgcaccccgccaccggcattgacgatctcatgcagcaaatcgccgaacacattgactcggactgtctgtttgccctttcccatcacgaactggaaacccgtttcggcttacccggcggcggctatgacaacatacagcggctgctgtttcccgacatccgccctgaagatcccgactaccatcagaaaatcatactggcaattgaagacttgcgttacggaaagcgcacgatcagccggcaggcacaagatgccttgatggaacaggaacgccgcctccgagaagcgacgctgttgctgatacagggcagtcaagaaacccgcggacaaggcgaggagccgaaacgcacgcgttattttgaagtttcggcaacccctgcctattcgagccggcacaacaacggacttggcggcaatttccaatacatcggccaattgcccggctatctgaaaatacacggagaaatgcttgaaaaccaatcactcttccggctgtccaaccgtgaacgcaatcccgacaaaccgtttttagacatccattttgacgaaaatggcaaaatcacgcgtattgtcgtttacgaaaaaaacatctacttcaatccaaacttggggcgaagataa

SEQ ID NO: 41135 - protein, 281 aa, Neisseria meningitidis
MKNKTSSLLLWLAAMMLTACSPSKEDKTKENGASAASSTASAASSSAPQTDLQPAASAPDNVKQAESVPPSNCTDLHPATGIDDLMQQIAEHIDSDCLFALSHHELETRFGLPGGGYDNIQRLLFPDIRPEDPDYHQKIILAIEDLRYGKRTISRQAQDALMEQERRLREATLLLIQGSQETRGQGEEPKRTRYFEVSATPAYSSRHNNGLGGNFQYIGQLPGYLKIHGEMLENQSLFRLSNRERNPDKPFLDIHFDENGKITRIVVYEKNIYFNPNLGRR

SEQ ID NO: 41136 - DNA, 435 bp, Neisseria gonorrhoeae
gtgccgctgcctgctccctgccgttttgccaaacctgccgcctcttttttaagtatggctttgctttcctgccagctttcccacgccgccacggcttatatccccccgaacgattttcaaccgaactgcgacatacgccggctcgggctgacacagggtcagcacaatgagctgcgtaaaatccgcgccgccttcaaaatggcgggcgacagggcgcgtttgaaggttatgcattccgaacacagccgccgccgctctgtcgtcgaaatcatttcttcggatgtttttaatcggaacgaggcgcgcgattatgtcgaaagccgctaccactccagcatggattttgcggtggacgaattggaaatccaacaccgcttcttccatattctcacaccgcaacagcagcaaatgtggctttcttcctgcctcaaataa

SEQ ID NO: 41137 - protein, 144 aa, Neisseria gonorrhoeae
VPLPAPCRFAKPAASFLSMALLSCQLSHAATAYIPPNDFQPNCDIRRLGLTQGQHNELRKIRAAFKMAGDRARLKVMHSEHSRRRSVVEIISSDVFNRNEARDYVESRYHSSMDFAVDELEIQHRFFHILTPQQQQMWLSSCLK

SEQ ID NO: 41138 - DNA, 435 bp, Neisseria meningitidis
gtgccactgcctgctccctgccgttttgccaaacctgccgcctcttttttaagtatggctttgctttcctgtcagctttcccacgccgccacggcttatatccccccgaacgattttcaaccgaactgcgacatacgccgactcgggctgacccaaagtcagcacaatgagctgcgtaaaatccgcaccgccttcaaaatggcgggcgacagggcgcgtttgaaggttatgcattccgaacacagccgccgccggtctgtcgtcgaaatcatttcctcggatgtttttaatcggaacgaggcgcgcgattatgtcgaaagccgctatttgtccggtatggattttgcggtggacgaattggaaatccaacaccggttcttccatatcctcacaccgcaacagcagcaaatgtggctttcttcctgcctcaaataa

SEQ ID NO: 41139 - protein, 144 aa, Neisseria meningitidis
VPLPAPCRFAKPAASFLSMALLSCQLSHAATAYIPPNDFQPNCDIRRLGLTQSQHNELRKIRTAFKMAGDRARLKVMHSEHSRRRSVVEIISSDVFNRNEARDYVESRYLSGMDFAVDELEIQHRFFHILTPQQQQMWLSSCLK

SEQ ID NO: 41140 - DNA, 435 bp, Neisseria meningitidis
  misc_feature (11)..(11): n is a, c, g, or t
gtgccactgcntgctccctgccgttttgccaaacctgccgcctcttttttaagtatggctttgctttcctgccagctttcccacgccgccacggcttatatccccctgaacgattttcaaccgaactgcgacatacgccggctcggactgacacagggtcagcacaatgaactgcgtaaaatccgcgccgccttcaaaatggcgggcgacagggcgcgtttgaaggttatgcattccgaacacagccgccgtcggtctgtcgtcgaaatcatttcctcggatgtttttaatcggaacgaggcgcgcgattatgtcgaaagccgctatttgtccggtatggattttgcggtggacgaattggaaatccaacaccggttcttccatatcctcacaccgcaacagcagcaaatgtggctttcttcctgcctcaaataa

SEQ ID NO: 41141 - protein, 144 aa, Neisseria meningitidis
  misc_feature (4)..(4): Xaa can be any naturally occurring amino acid
VPLXAPCRFAKPAASFLSMALLSCQLSHAATAYIPLNDFQPNCDIRRLGLTQGQHNELRKIRAAFKMAGDRARLKVMHSEHSRRRSVVEIISSDVFNRNEARDYVESRYLSGMDFAVDELEIQHRFFHILTPQQQQMWLSSCLK

SEQ ID NO: 41142 - DNA, 1014 bp, Neisseria gonorrhoeae
gtatcgcacacacgctgtcgctgttcggaatcgatacgccggatttggcggaatggcagggaatggcggattaaaggacaaaaatgccgtctgaacacggatgcggttcagacggcatcattttatacgactgccttatttggctgcgccttcattccatgcggcagggtatttgtagccctcgaagcgtttgtgcgcgtaggctttgaacgcgtcggagttataggcctcggttacgtctttaagccattggctgtctttgtcggcggttttgacggcagaccagttgacataggcaaagctcggctcttggaacagggcttcggtcagcttcatgccgctgcttatggcgtagttgccgttgacgacggcaaaatccacgtcggcgcggctgcgcggcagttgtgcggcttcaagctcgacgattttgatgtttttcaggttttccgcgatgtcggctttggatgcggtcagcggattgatgccgtctttgagtttgatccaacccagttcgttcagcatcaccaaggcgcgtgcgaagttggacgggtcgttgggcgcggatacggtgctgccgtctttgacttcttccagcgatttcagtttgcccggatacagtcccaaaggcgcggtcggcacttggaaggcttcggtgatgtccaggttgtgttcttttttgaaatcgtcaagatagggtttgtgttggaagacgttgatgtccaactcgccctccgccaatgccagattcgggcgcacatagtcggtaaattcgaccaatttgacggtgtagccttttttctccagctcggcttggatttgttctttgaccatatcgccgaagtcgcccacggtcgtgccgaagacgatttcttttttcgccgcgccgttatcggcagaaggggcggcggcagaggctgcgggcgcgctgtctttttgaccgccgcaggctgcgaggatgagcgcgagtgcggcggcggaaagggttttgaagaaggttttcatattttctcctga

SEQ ID NO: 41143 - protein, 337 aa, Neisseria gonorrhoeae
VSHTRCRCSESIRRIWRNGREWRIKGQKCRLNTDAVQTASFYTTALFGCAFIPCGRVFVALEAFVRVGFERVGVIGLGYVFKPLAVFVGGFDGRPVDIGKARLLEQGFGQLHAAAYGVVAVDDGKIHVGAAARQLCGFKLDDFDVFQVFRDVGFGCGQRIDAVFEFDPTQFVQHHQGACEVGRVVGRGYGAAVFDFFQRFQFARIQSQRRGRHLEGFGDVQVVFFFEIVKIGFVLEDVDVQLALRQCQIRAHIVGKFDQFDGVAFFLQLGLDLFFDHIAEVAHGRAEDDFFFRRAVIGRRGGGRGCGRAVFLTAAGCEDERECGGGKGFEEGFHIFS

SEQ ID NO: 41144 - DNA, 1011 bp, Neisseria meningitidis
gtgttgcacacgctttgtcgctgttcggaatcgatacgccggattcggcggaatggcagggaatggcggattaaaggacaaaaatgccgtctgaacacggatacagttcagacggcatcattttatacgactgccttatttggctgcgccttcattccatgcggcaggggatttgtagccctcgaagcgtttgtgcgcgtaggctttgaacgcgtcggagttataggcctcggttacgtctttaagccattggctgtctttgtcggcggttttgacggcagaccagttgacataggcaaagctcggttcttggaacagggcttcggtcagcttcatgccgctgcttatggcgtagttgccgttgacgacggcaaaatccacgtcggcgcggctacgcggcagttgcgcggcttcaagctcgacgattttgatgtttttcaggttctcggcgatgtccgctttggatgcggtcaacggattgatgccgtctttgagtttgatccaacccagttcgtcgagcatcaccaagacgcgggcgaagttggacgggtcgttgggcgcggatacggtgctgccgtctttgacttcttccagcgatttcagcttgcccgggtacagtcccaaaggcgcggtcggcacttggaagacttcggtgatgtccagattgtgttcttttttgaagtcgtcaagatagggtttgtgttggaagacgttgatgtccaactcgccctcagccaatgccagattcgggcgtacatagtcggtaaactcgaccagtttgacggtgtagccttttttctccagctcggcttggatttgttctttgaccatatcgccgaagtcgccgacggtcgtgccgaagacgatttcttttttcgccgcgccgttgtcggcggcggcagaagcggatgcggcgggcgcgctgtctttttgaccgccgcaggcggcgaggatgagcgcgagtgcggcggcggaaagggttttgaagaaggttttcatattttctcctga

SEQ ID NO: 41145 - protein, 336 aa, Neisseria meningitidis
VLHTLCRCSESIRRIRRNGREWRIKGQKCRLNTDTVQTASFYTTALFGCAFIPCGRGFVALEAFVRVGFERVGVIGLGYVFKPLAVFVGGFDGRPVDIGKARFLEQGFGQLHAAAYGVVAVDDGKIHVGAATRQLRGFKLDDFDVFQVLGDVRFGCGQRIDAVFEFDPTQFVEHHQDAGEVGRVVGRGYGAAVFDFFQRFQLARVQSQRRGRHLEDFGDVQIVFFFEVVKIGFVLEDVDVQLALSQCQIRAYIVGKLDQFDGVAFFLQLGLDLFFDHIAEVADGRAEDDFFFRRAVVGGGRSGCGGRAVFLTAAGGEDERECGGGKGFEEGFHIFS

SEQ ID NO: 41146 - DNA, 1011 bp, Neisseria meningitidis
gtgttgcacacgctttgtcgctgttcggaatcgatacgccggattcggcggaatggcagggaatggcggattaaaggacaaaaatgccgtctgaacacggatacggttcagacggcatcattttatacgactgccttatttggctgcgccttcattccatgcggcaggggatttgtagccctcgaagcgtttgtgcgcgtaggctttgaacgcgtcggagttataggcctcggttacgtctttaagccattggctgtctttgtcggcggttttgacggcagaccagttgacataggcaaagctcggttcttggaacagggcttcggtcagcttcatgccgctgcttatggcgtagttgccgttgacgacggcaaaatccacgtcggcgcggctacgcggcagttgcgcggcttcaagctcgacgattttgatgtttttcaggttttcggcaatgtccgctttggatgcggtcagcggattgatgccgtctttgagtttgatccaacccagttcgtcgagcatcaccaagacgcgggcgaagttggacgggtcgttgggcgcggatacggtgctgccgtctttgacttcttccagcgatttcagcttgcccgggtacagtcccaaaggcgcggtcggcacttggaagacttcggtgatgtccagattgtgttcttttttgaagtcgtcaagatagggtttgtgttggaagacgttgatgtccaactcgccctcagccaatgccagattcgggcgcacatagtcggtaaactcgaccagtttgacggtgtagccttttttctccagctcgggttggatttgttctttgaccatatcgccgaagtcgccgacggtcgtgccgaagacgatttcttttttcgccgcgccgttgtcggcggcggcagaagcggatgcggcgggcgcgctatctttttgaccgccgcaggcggcgaggatgagcgcgagtgcggcggcggaaagggttttgaagaaggttttcatattttctcctga

SEQ ID NO: 41147 - protein, 336 aa, Neisseria meningitidis
VLHTLCRCSESIRRIRRNGREWRIKGQKCRLNTDTVQTASFYTTALFGCAFIPCGRGFVALEAFVRVGFERVGVIGLGYVFKPLAVFVGGFDGRPVDIGKARFLEQGFGQLHAAAYGVVAVDDGKIHVGAATRQLRGFKLDDFDVFQVFGNVRFGCGQRIDAVFEFDPTQFVEHHQDAGEVGRVVGRGYGAAVFDFFQRFQLARVQSQRRGRHLEDFGDVQIVFFFEVVKIGFVLEDVDVQLALSQCQIRAHIVGKLDQFDGVAFFLQLGLDLFFDHIAEVADGRAEDDFFFRRAVVGGGRSGCGGRAIFLTAAGGEDERECGGGKGFEEGFHIFS

SEQ ID NO: 41148 - DNA, 1119 bp, Neisseria gonorrhoeae
  misc_feature (1062)..(1063): n is a, c, g, or t
tcggcatttgtgttgcccaaacatccgatgcctgcgttaacgcctgcgtcaacgtttgcacaaatcgggtttggtttcgccctcgcggcgcagctccttgggcaggacgaacacgatgctttcttccgcgccccccccttcgcgcacggtttcatgcccccatccgcgtatggttgccaatacttcccgcaccaacacttcgggcgcggacgcgcctgccgttacgccgactttgcttttgccttcaaaccacgtgcgttgcaggtaggacgcgttgtccaccatatacgcatcgattccgcgcgatgccgccacttcgcgcaggcggttgctgttggacgaattgggcgaaccgaccacaatcacgatgtcgcactgttccgccagctctttgacggcggtttgccggttggtcgtcgcatagcagatgtcttccttgtgcggattgcggatattggggaaacgcgcgttcagcgcggcgatgatgtctttggtttcatcgaccgagagcgtggtttggctgacataggcgagtttgtcggggtttctgacttcgagttttgccacatctccgaccgtttcgaccaaaagcattttgcccggtgcaagctgccccatcgtgccttcgacctcggcgtgccccttatgcccgatcatgatgatttcacagtcttgggcatccagtcgggcgacttccttatgcactttcgtcaccagcgggcaagtcgcatcaaatacccggaaaccgcgctccgccgcttcctgctgcaccgccttcgatacgccgtgtgccgaataaaccagtgtcgcgcccggcggcacttccgccaagtcttcgataaacaccgcgcctttttcgcgcaggttgtccacgacgaatttgttgtggacgacttcgtggcgcacataaaccggcgcgccgaattcttccaaagcacgttcgacaatactgattgcccgatccacaccggcgcagaagccgcgcggattggcaaggatgatggtttttccgttcataagttttgcattccgtgttcagacggcattcacgtttttttgctnnatctttgcgatggacgatattgtcaagcaccgccaacaccgcaccgacgcagataa

SEQ ID NO: 41149 - protein, 372 aa, Neisseria gonorrhoeae
  misc_feature (355)..(355): Xaa can be any naturally occurring amino acid
SAFVLPKHPMPALTPASTFAQIGFGFALAAQLLGQDEHDAFFRAPPFAHGFMPPSAYGCQYFPHQHFGRGRACRYADFAFAFKPRALQVGRVVHHIRIDSARCRHFAQAVAVGRIGRTDHNHDVALFRQLFDGGLPVGRRIADVFLVRIADIGETRVQRGDDVFGFIDRERGLADIGEFVGVSDFEFCHISDRFDQKHFARCKLPHRAFDLGVPLMPDHDDFTVLGIQSGDFLMHFRHQRASRIKYPETALRRFLLHRLRYAVCRINQCRARRHFRQVFDKHRAFFAQVVHDEFVVDDFVAHINRRAEFFQSTFDNTDCPIHTGAEAARIGKDDGFSVHKFCIPCSDGIHVFLLXLCDGRYCQAPPTPHRRR

SEQ ID NO: 41150 - DNA, 1158 bp, Neisseria meningitidis
ttggtttccgcatccggcacacggcaaaaatgccgtctgaagcctgttcagacggcatttgtgttgcccaaacattcaacgcctgcgtcaacgtttgcacaaatcgggtttggtttcgccctcgcggcgcaactctttgggcaggacgaacacaatgctttcttccgcaccctcgccttcgcgtacggtttcgtgcccccatccgcgtatggttgccagtacttcccgcaccaacacttcgggcgcggacgcgcctgccgttacgccgactttgtttttgccctcaaaccatgcgcgttgcaggtagcctgcattatccaccatatacgcatcgattccgcgcgatgccgccacttcgcgcaagcggttgctgttggacgaattgggcgaaccgaccacaatcacgatgtcgcactgttctgccaactctttgacggcggtttgccggttggtcgtcgcatagcagatatcttccttgtgcggattgcggatattggggaaacgcgcgttcagcgcggcgatgatgtctttggtttcatcgaccgagagcgtggtttggctgacataggcgagtttgtcggggtttctgacttcgagttttgccacatctccgaccgtttcgaccaaaagcattttgcccggcgcaagctgccccatcgttccttcgacctcgacgtgccccttatgcccgatcatgatgatttcacagtcttgggcatccagtcgggcgacttccttatgcactttcgtcaccagcgggcaagtcgcatcaaacacgcggaaaccgcgctccgccgcttcttgccgcaccgccttcgatacgccgtgtgccgaataaaccagtgtcgcgcccggcggcacttccgccaagtcttcaataaacaccgcacctttttcacgcaggttgtccacgacgaatttgttgtgaacgacttcgtggcgcacataaatcggcgcgccgaactcttccaaagcacgttcgacaatactgattgcccgatccacaccagcgcagaagccgcgcggattggcaaggatgatggttttctcgttcataagcccggtatttcgttttcagacggcatcaatatttttcttcttgggttttacggtggacgatgttgtccaacaccgccaacaccgcaccgacgcagataa

SEQ ID NO: 41151 - protein, 385 aa, Neisseria meningitidis
LVSASGTRQKCRLKPVQTAFVLPKHSTPASTFAQIGFGFALAAQLFGQDEHNAFFRTLAFAYGFVPPSAYGCQYFPHQHFGRGRACRYADFVFALKPCALQVACIIHHIRIDSARCRHFAQAVAVGRIGRTDHNHDVALFCQLFDGGLPVGRRIADIFLVRIADIGETRVQRGDDVFGFIDRERGLADIGEFVGVSDFEFCHISDRFDQKHFARRKLPHRSFDLDVPLMPDHDDFTVLGIQSGDFLMHFRHQRASRIKHAETALRRFLPHRLRYAVCRINQCRARRHFRQVFNKHRTFFTQVVHDEFVVNDFVAHINRRAELFQSTFDNTDCPIHTSAEAARIGKDDGFLVHKPGISFSDGINIFLLGFYGGRCCPTPPTPHRRR

SEQ ID NO: 41152 - DNA, 1158 bp, Neisseria meningitidis; identical to SEQ ID NO: 41150

SEQ ID NO: 41153 - protein, 385 aa, Neisseria meningitidis; identical to SEQ ID NO: 41151

SEQ ID NO: 41154 - DNA, 918 bp, Neisseria gonorrhoeae
ttgcctcaaactcgtccggcaaggcggcatcatcgccatcgacaatattttgttgaacggaagggtgatgcgcgaagcggcttttgatgcgccgcccagtgtcaaaattctcaaagatttcaatcaaaacctgccgaacgatacgcggattgtccccatcaccctgcccgtcggcgacggtttgaccctgcttctgaaaaaataatgaagaccaaattaccgctttttatcatttggctgtctgtgtctgcctcctgtgcttccgttttacccgttccggagggcagccgaaccgaaatgccgacacaggaaaatgcttcagacggcattccctatcccgttcccactctgcaagaccgtttggactatctggaaggcaaaatcgtccggctgtcgaacgaagtggaaatgttaaacgggaaagtcaaagcattggagcatacgaaaatacacccttccggcaggacatacgtccaaaaactcgacgaccgcaaattgaaagagcattacctcaataccgaaggcggcagcgcatccgcacataccgtcgaaaccgcacaaaacctctacaatcaggcactcaaacactatcaaaacggcaggttttctgccgcagccgccttgttgaagggggcggacggcggagacggcggcagcatcgcgcaacgcagtatgtacctgttgctgcaaagcagggcgcgtatggggaactgtgaatctgtcatcgaaatcggagggcgttacgccaaccgtttcaaagacagcccaaccgcgcccgaagtcatattcaaaatcggcgaatgccaatacaggcttcagcaaaaagacattgcaagggcgacttggcgcagcctgatacagacctatcccggcagcccggcggcaaaacgcgccgccgcagccgtacgcaaacgatag

SEQ ID NO: 41155 - protein, 304 aa, Neisseria gonorrhoeae
LPQTRPARRHHRHRQYFVERKGDARSGFCAAQCQNSQRFQSKPAERYADCPHHPARRRRFDPASEKIMKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 41156 - DNA, 918 bp, Neisseria meningitidis
ttgcctcaaactcgtccgtcaaggcggcatcatcgccatcgacaatattttgctgaacggaagggtgatgcgcgaagcggcttccgatgcgccgcccagcgtcggcatcctcaaagatttcaatcaaaacctgccgaacgacccgcgcatcgtccccatcaccctgcccgtcggcgacggcttgaccctgcttctgaaaaaataatgaagatcaaattaccgctttttatcatttggctgtctgtgtccgcctcctgtgcttccgtttcacccgttccggcaggcagccaaaccgaaatgtcgacacgggaaaatgcttcagacggcattccctatcccgttccgaccttgcaagaccgtttggactatctggaaggcaaaatcgtccggctgtcgaacgaagtggaaaccttaaacggcaaagtcaaagcactggaacacgcaaaaacacattcttccggcagggcatacgtccaaaaactcgacgaccgcaagttgaaagagcattacctcaataccgaaggcggcagcgcatccgcacatactgtcgaaaccgcacaaaacctctacaatcaggcactcaaacactataaaagcggcaagttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 41157 - protein, 305 aa, Neisseria meningitidis
LPQTRPSRRHHRHRQYFAERKGDARSGFRCAAQRRHPQRFQSKPAERPAHRPHHPARRRRLDPASEKIMKIKLPLFIIWLSVSASCASVSPVPAGSQTEMSTRENASDGIPYPVPTLQDRLDYLEGKIVRLSNEVETLNGKVKALEHAKTHSSGRAYVQKLDDRKLKEHYLNTEGGSASAHTVETAQNLYNQALKHYKSGKFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 41158 - DNA, 921 bp, Neisseria meningitidis
ttgcctcaagcttgtccggcaaggcggcatcattgccatcgacaatattttgttgaacggaagggtgatgcgcgaagcggcttccgatgcgccgcccagcgtcggcatcctcaaagattttaatcaaaacctgccgaacgatacgcggattgtccccatcaccctgcccgtcggcgacggtttgaccctgcttctgaaaaaataatgaagaccaaattaccgctttttatcatttggctgtccgtatccgccgcctgttcttcccctgtttcccgcaatattcaggatatgcggctcgaaccgcaggcagaggcaggtagttcggacgctattccctatcccgttcccactctgcaagaccgtttggattatctggaaggcacactcgtccgcctgtcgaacgaagtggaaaccttaaacggcaaagtcaaagcactggagcatgcgaaaacacacccttccagcagggcatacgtccaaaaactcgacgaccgcaagttgaaagagcattacctcaataccgaaggcggcagcgcatccgcacataccgtcgaaaccgcacaaaacctctacaatcaggcactcaaacactataaaagcggcaggttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 41159 - protein, 305 aa, Neisseria meningitidis
LPQACPARRHHCHRQYFVERKGDARSGFRCAAQRRHPQRFSKPAERYADCPHHPARRRRFDPASEKIMKTKLPLFIIWLSVSAACSSPVSRNIQDMRLEPQAEAGSSDAIPYPVPTLQDRLDYLEGTLVRLSNEVETLNGKVKALEHAKTHPSSRAYVQKLDDRKLKEHYLNTEGGSASAHTVETAQNLYNQALKHYKSGRFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 41160 - DNA, 363 bp, Neisseria meningitidis
ttgggttgccggcaggcggcatcccatcatttttgccaaggcaacaaattatttggcggcatctttcattttgtctgccgcttcctgagtcgcgtcggcagctttgttcaaagtatctttagctgcttcagttacagcttctttggcttcagttacagcttcctcggcacttgcctttgcatcagccgcagcatctttgacttggtctttcgcttcttcgacggcagaagcggcagactcggcggcagaagccgcagtgtctttaacatcggactcaacggcttgaaccgcttccttaacctcctgtttggcttcttgcgaacaagctgccaaggcagccgccatcattgcggcaatcaataa

SEQ ID NO: 41161 - protein, 120 aa, Neisseria meningitidis
LGCRQAASHHFCQGNKLFGGIFHFVCRFLSRVGSFVQSIFSCFSYSFFGFSYSFLGTCLCISRSIFDLVFRFFDGRSGRLGGRSRSVFNIGLNGLNRFLNLLFGFLRTSCQGSRHHCGNQ

SEQ ID NO: 41162 - DNA, 363 bp, Neisseria meningitidis; identical to SEQ ID NO: 41160

SEQ ID NO: 41163 - protein, 120 aa, Neisseria meningitidis; identical to SEQ ID NO: 41161

SEQ ID NO: 41164 - DNA, 903 bp, Neisseria gonorrhoeae
atgagcagcctgatgacgttgttttcggtattggtaccgatgtttgccggattttttatccgtgttcccaagccttacctgcccgcttcggacaaggtgctgtcggttttggtgtatgccgtgctgctgctgatcggcgtatcgttgtcgcgcgtggaggatttgggttcgcggttgggcgatatggcgttgacggttctgtggctgtttgtttgtacggtaggggcgaacctgcttgccttggcagtgttgggaaagttgtccccgtggcggatagggggaaaagggaagggcgtttcggtcggcgtgtcgggcagtgtgaggcagctcggatgcgtactgctcggttttgtgtccggcaaattgatgtgcgatatttggatgccgtctgaaaacgcgggtatgtactgcctgatgctgctggtgttcctcatcggcgtacagctcaaaagtagcggcgtatcgttgcggcaggttttgcttaaccggcggggcatccggctgtcggtttggtttatattgtcatctctttcaggcgggctgctgtttgccgcatcggcagatggtgtgtcgtggacgaaaggtttggcgatggcttccggcttcggttggtattccctctcgggtttggtaatgaccgaggcttacggggcggtatggggcagcatcatgctgctgaacgatttggcacgagagctgtttgcactggcatttattccgctgctgatgaagcgttttccggatgcggcggtgggggtcggcggcgcgaccagtatggatttcacattgcccgtaattcagggtgcgggcggtttggaagtcgtgccggtagcggtcagcttcggcgtggtggtcaatatcgccgccccgtttctgatggtggtgttttccacgctgggctga

SEQ ID NO: 41165 - protein, 300 aa, Neisseria gonorrhoeae
MSSLMTLFSVLVPMFAGFFIRVPKPYLPASDKVLSVLVYAVLLLIGVSLSRVEDLGSRLGDMALTVLWLFVCTVGANLLALAVLGKLSPWRIGGKGKGVSVGVSGSVRQLGCVLLGFVSGKLMCDIWMPSENAGMYCLMLLVFLIGVQLKSSGVSLRQVLLNRRGIRLSVWFILSSLSGGLLFAASADGVSWTKGLAMASGFGWYSLSGLVMTEAYGAVWGSIMLLNDLARELFALAFIPLLMKRFPDAAVGVGGATSMDFTLPVIQGAGGLEVVPVAVSFGVVVNIAAPFLMVVFSTLG

SEQ ID NO: 41166 - DNA, 903 bp, Neisseria meningitidis
atggacagcctgatgacgttgctttcggtattgataccgatgtttgccggattttttatccgtgtgcccaagccttacctgcccgctttggataaggtgctatcggtcttggtgtatgctgtgctgctgctgatcggcgtctcgttgtcgcgcgtggaggatttgggttcgcggttggacgatatggcgttgacggttctgtggctgtttgtttgtacggtcggggcgaacctgcttgctttggcagtgttgggaaagttattcccgtggcggataaaggggaaagggaagggcgtttcggtcggcgtgtcgggcagtgtggggcagctcggatgcgtgctgctcggatttgcattcggcaaactgatgcgcgatatttggatgccgtctgaaagcgcgggcatgtattgtctgatgctgctggtgttcctcatcggcgtacagctcaaaagcagcggcgtatcgttgcggcaggttttggtcaaccgcaggggtattcggttgtcggtctggtttatgctttcatctctttcgggcgggctgctgtttgccgcatcgacagacggtgtgtcgtggacgaaaggtttggcgatggcttccggcttcggttggtattccctctcgggtttggtcatgaccgaggcttacggcgcggtatggggcagcatcatgctgctgaacgatttggcacgagagctgtttgcactggcatttatcccgctgctgatgaagcgttttccagatgcggcggtgggggttggcggtgcgaccagtatggattttacattgcccgtgattcagggtgcgggcggtttggaagtcgtgccggtagcggtcagcttcggcgtggtggtcaatatcgccgccccgtttctgatggtggtgttttccgctttgggttga

SEQ ID NO: 41167 - protein, 300 aa, Neisseria meningitidis
MDSLMTLLSVLIPMFAGFFIRVPKPYLPALDKVLSVLVYAVLLLIGVSLSRVEDLGSRLDDMALTVLWLFVCTVGANLLALAVLGKLFPWRIKGKGKGVSVGVSGSVGQLGCVLLGFAFGKLMRDIWMPSESAGMYCLMLLVFLIGVQLKSSGVSLRQVLVNRRGIRLSVWFMLSSLSGGLLFAASTDGVSWTKGLAMASGFGWYSLSGLVMTEAYGAVWGSIMLLNDLARELFALAFIPLLMKRFPDAAVGVGGATSMDFTLPVIQGAGGLEVVPVAVSFGVVVNIAAPFLMVVFSALG

SEQ ID NO: 41168 - DNA, 903 bp, Neisseria meningitidis
  misc_feature (430)..(430): n is a, c, g, or t
atggacagcctgatgacgttgctttcggtattgataccgatgtttgccggattttttatccgtgtgcccaagccttacctgcccgctttggataaggtgctatcggtcttggtgtatgctgtgctgctgctgatcggcgtctcgttgtcgcgcgtggaggatttgggttcgcggttggacgatatggcgttgacggttctgtggctgtttgtttgtacggtcggggcgaacctgcttgctttggcagtgttgggaaagttattcccgtggcggataaaggggaaagggaagggcgtttcggtcggtgtgtcgggcagtgtggggcagctcggatgcgtgctgctcggatttgcatccggcaaactgatgcgcgatatttggatgccgtctgaaaacgcgggtatgtattgtctgatgctgctggtgctcntcatcggcgtacagctcaaaagcagcggcgtatcgttgcggcaggttttggtcaaccgcaggggtattcggttgtcggtctggtttatgctttcatctctttcaggcgggctgctgtttgccgcatcggcagacggtgtgtcgtgggtgaaaggtttggcgatggcttccggcttcggttggtattccctctcgggtttggtgatgaccgaggcttacggcgcggtatggggcagtatcgcgcttttgaacgatttggcacgagagctgttcgcgctggcatttattccgctgctgatgaagcgttttcccgatgcggcagtgggggtcggcggcgcgaccagtatggatttcacattgcccgtgattcggggtgcgggcggcttggaagccgtaccggtagcggtcagcttcggcgtggtggtcaatatcgccgctccgtttctgatggtggtgttttccgctttgggctga

SEQ ID NO: 41169 - protein, 300 aa, Neisseria meningitidis
  misc_feature (144)..(144): Xaa can be any naturally occurring amino acid
MDSLMTLLSVLIPMFAGFFIRVPKPYLPALDKVLSVLVYAVLLLIGVSLSRVEDLGSRLDDMALTVLWLFVCTVGANLLALAVLGKLFPWRIKGKGKGVSVGVSGSVGQLGCVLLGFASGKLMRDIWMPSENAGMYCLMLLVLXIGVQLKSSGVSLRQVLVNRRGIRLSVWFMLSSLSGGLLFAASADGVSWVKGLAMASGFGWYSLSGLVMTEAYGAVWGSIALLNDLARELFALAFIPLLMKRFPDAAVGVGGATSMDFTLPVIRGAGGLEAVPVAVSFGVVVNIAAPFLMVVFSALG

SEQ ID NO: 41170 - DNA, 387 bp, Neisseria gonorrhoeae
atgtcttggcacatattccaagttgcagggataccgaccgcttcgatggcacaatctacgccgtcttcgccgacgatggcgaaaacttgtttggagacgtcgccggaagcggggctgatggtatgggtcgcgcccaactctttcgccggtttcaaacggttttcgtccatatcgcacacgataatggcggcagggctatacagttgggcggtcaacaaggcggacataccgacagggccggcacctgcgatgaatacggtatcgccgggtttcacatcgccgtattgcacgccgatttcgtgggcggtcggtaaagcgtcgctcaacagcagggcgatttcttcgttgacgttgtcgtgcggcggcacgaggctgttgtcggcataa

SEQ ID NO: 41171 - protein, 128 aa, Neisseria gonorrhoeae
MSWHIFQVAGIPTASMAQSTPSSPTMAKTCLETSPEAGLMVWVAPNSFAGFKRFSSISHTIMAAGLYSWAVNKADIPTGPAPAMNTVSPGFTSPYCTPISWAVGKASLNSRAISSLTLSCGGTRLLSA

SEQ ID NO: 41172 - DNA, 387 bp, Neisseria meningitidis
atgtcttggcacatattccatgtagcagggataccgacggcttcgatggcgcaatccacgccgtcttcgccgacgatggcaaagacttgtttggatacttcgccggaagcagggttaatggtatgggtcgcacccaattctttcgccagtttcaaacggttttcgtccatatcgcaaacgatgatggcggcgggactgtacagttgggcggtcaacagggcggacataccgacagggcctgccccagcgatgaatacggtgtcgccgggtttgacatcgccgtattgcacgccgatttcgtgggcggtcggcaaagcgtcgctcaacaacagggcgatttcttcgttgacattatcgggcagcggaacgaggctgttgtcggcataa

SEQ ID NO: 41173 - protein, 128 aa, Neisseria meningitidis
MSWHIFHVAGIPTASMAQSTPSSPTMAKTCLDTSPEAGLMVWVAPNSFASFKRFSSISQTMMAAGLYSWAVNRADIPTGPAPAMNTVSPGLTSPYCTPISWAVGKASLNNRAISSLTLSGSGTRLLSA

SEQ ID NO: 41174 - DNA, 387 bp, Neisseria meningitidis
atgtcttggcacatattccaagttgcagggataccgacggcttcgatcgcgcagtccacgccgtcttcgccgacgatagcggcaacttgcttgcttacatcgccggaagcagggttaatggtatgggttgcgcccaactctttcgccagtttcaaacggttttcgtccatatcgcaaacaatgatggcggcggggctgtacagttgggcggtcggcaaggcggacataccgacaggagcggcacctgcgatgaatacggtgtcgccgggtttgacatcgccgtattgcacgccgatttcgtgtgcggtcggcaaagcgtcgctcaacaacagggcgacttcttcgttgacgttgtcgggcagcggcacgaggctgttgtcggcataa

SEQ ID NO: 41175 - protein, 128 aa, Neisseria meningitidis
MSWHIFQVAGIPTASIAQSTPSSPTIAATCLLTSPEAGLMVWVAPNSFASFKRFSSISQTMMAAGLYSWAVGKADIPTGAAPAMNTVSPGLTSPYCTPISCAVGKASLNNRATSSLTLSGSGTRLLSA

SEQ ID NO: 41176 - DNA, 375 bp, Neisseria gonorrhoeae
atgccgtgttccaaagccagttggacttcgcccggagtggcaacgccgggaatcaggggaatgccgctgttgcggccggctctggcgagggattcgtgcaaacccgggctgatggcgaaaaccgcgcctgcgtcttcgacggctttgagctgttcgggattggttaccgtacctgcgccgatgatggcgttgggcatttctttggcaatcaggcggatggcctcgagtccgacgggggtgcgcaaggtaatttcgagggtggggatgccgccttcgacaagggcgcgggacaaatcgacggcggtgcttaagtcgtcaatcgccatcacaggcacaactgcgccggcggtcaggatttcgcggggggtcagttga

SEQ ID NO: 41177 - protein, 124 aa, Neisseria gonorrhoeae
MPCSKASWTSPGVATPGIRGMPLLRPALARDSCKPGLMAKTAPASSTALSCSGLVTVPAPMMALGISLAIRRMASSPTGVRKVISRVGMPPSTRARDKSTAVLKSSIAITGTTAPAVRISRGVS

SEQ ID NO: 41178 - DNA, 432 bp, Neisseria meningitidis
atgccgtgttccaaagccagttggatttcgcccggggtggcaacaccgggaatcagggggatgccgctgttgtggccggctttggcgagggattcatgcagccccgggctgatggcgaaaaccgcgcctgcgtcttcgacggctttgagctgttcgggattggttaccgtacctgcgccgacgatggcgttgggcacttctttggcaatcaggcggatggcatcgaggccgacaggggtgcgcagggtgatttcgagggtagggatgccgccttcgacaagggcgtgggacaaatcgatggcggtgcttaagtcgtcaatcgccattaccggcacaactgcgccggcggtcaaaatttcgcggggggtcagtttggacatttcggttctccgggtggaatggggtattttattaagatgggacaggttgtag

SEQ ID NO: 41179 - protein, 143 aa, Neisseria meningitidis
MPCSKASWISPGVATPGIRGMPLLWPALARDSCSPGLMAKTAPASSTALSCSGLVTVPAPTMALGTSLAIRRMASRPTGVRRVISRVGMPPSTRAWDKSMAVLKSSIAITGTTAPAVKISRGVSLDISVLRVEWGILLRWDRL

SEQ ID NO: 41180 - DNA, 432 bp, Neisseria meningitidis; identical to SEQ ID NO: 41178

SEQ ID NO: 41181 - protein, 143 aa, Neisseria meningitidis; identical to SEQ ID NO: 41179

SEQ ID NO: 41182 - DNA, 867 bp, Neisseria gonorrhoeae
atgaaagcaaaaatcctgacttccgttgcgctgcttgcctgttccggcagcctgtttgcccaaacgctggcaaccgttaacggtcagaaaatcgacagttccgtcatcgatgcgcaggttgccgcattccgtgcggaaaacagccgtgccgaagacacgccgcaactgcgccaatccctgctggaaaacgaagtggtcaacaccgtggtcgcacaggaagtgaaacgcctgaaactcgaccggtcggcagagtttaaagatgcgcttgccaaattgcgtgccgaagcgaaaaagtcgggcgacgacaagaaaccgtccttcaaaaccgtttggcaggcggtaaaatatggcttgaacggcgaggcatacgcactgcatatcgccaaaacccaaccggtttccgagcaggaagtaaaagccgtttacgacaatatcagcggtttttataaaggcacgcaggaagtccagttgggcgaaatcctgaccgacaaggaagaaaatgcgaaaaaagcggttgccgatttgaaggcgaaaaaaggttttgatgccgttttgaaacaatactcgctcaacgaccgcaccaaacggaccggcgcgccggacggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtgaaagtgccttcttttgacgaaatgaaaggacagattgccggcaaccttcaggcggaacggattgaccgtgccgtctgtgcgctgttgggtaaggcaaacatcaaacctgcaaaataa

SEQ ID NO: 41183 - protein, 288 aa, Neisseria gonorrhoeae
MKAKILTSVALLACSGSLFAQTLATVNGQKIDSSVIDAQVAAFRAENSRAEDTPQLRQSLLENEVVNTVVAQEVKRLKLDRSAEFKDALAKLRAEAKKSGDDKKPSFKTVWQAVKYGLNGEAYALHIAKTQPVSEQEVKAVYDNISGFYKGTQEVQLGEILTDKEENAKKAVADLKAKKGFDAVLKQYSLNDRTKRTGAPDGYVPLKDLEQGVPPLYQAIKDLKKGEFTATPLKNGDFYGVYYVNDSREVKVPSFDEMKGQIAGNLQAERIDRAVCALLGKANIKPAK

SEQ ID NO: 41184 - DNA, 867 bp, Neisseria meningitidis
atgaaagcaaaaatcctgacttccgttgcactgcttgcctgttccggcagcctgtttgcccaaacgctggcaaccgtcaacggtcagaaaatcgacagttccgtcatcgatgcgcaggttgccgcattccgtgcggaaaacagccgtgccgaagacacgccgcaactgcgccaatccctgctggaaaacgaagtggtcaataccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcattgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataa

SEQ ID NO: 41185 - protein, 288 aa, Neisseria meningitidis
MKAKILTSVALLACSGSLFAQTLATVNGQKIDSSVIDAQVAAFRAENSRAEDTPQLRQSLLENEVVNTVVAQEVKRLKLDRSAEFKNALAKLRAEAKKSGDDKKPSFKTVWQAVKYGLNGEAYALHIAKTQPVSEQEVKAAYDNISGFYKGTQEVQLGEILTDKEENAKKAVADLKAKKGFDAVLKQYSLNDRTKQTGAPVGYVPLKDLEQGVPPLYQAIKDLKKGEFTATPLKNGDFYGVYYVNDSREVKVPSFDEMKGQIAGNLQAERIDRAVGALLGKANIKPAK

SEQ ID NO: 41186 - DNA, 867 bp, Neisseria meningitidis
atgaaagcaaaaatcctgacttccgttgcactgcttgcctgttccggcagcctgtttgcccaaacgctggcaaccgtcaacggtcagaaaatcgacagttccgtcattgatgcgcaggttgccgcattccgtgcggaaaacagccgtgccgaagacacgccgcaactgcgccaatccctgctggaaaacgaagtggtcaacaccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcgctgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataa

SEQ ID NO: 41187 - protein, 288 aa, Neisseria meningitidis; identical to SEQ ID NO: 41185

SEQ ID NO: 41188 - DNA, 2472 bp, Neisseria meningitidis
atgaaaaaaacctgtttccactgcgggctggacgttcccgaaaacctgcatctgaccgtccgttacgaaaacgaagaccgcgaaacctgctgcgccggttgtcaggcagtcgcacaaagcattattgacgcgggcttgggcagttattacaaacaacgcaccgccgacgcgcaaaaaaccgagctgccgccccaagaaatcctcgaccaaatccgcctgtacgacctgcccgaagtccagtccgactttgtggaaacccacggcggcacgcgcgaggcggttttaatgctcggcggcatcacctgcgccgcctgcgtctggctgatcgaacagcagcttttgcgtacagacggcatcgtccgcatcgacctcaattacagcacgcaccgctgccgcgtcgtctgggacgacggcaaaatccgcctttccgacattctgttgaaaatcaggcagataggctacaccgccgcaccctatgacgcgcaaaaaatcgaagccgccaaccaaaaagaacgcaaacaatacatcgtccgcctcgccgttgccgggctggggatgatgcagacgatgatgttcgcgctgccgacctacctttacggcggcgacatcgaacccgatttcctgcaaatcctccattggggcggctttttaatggtgctgcccgtcgtattctattgcgccgtcccgttttatcaaggcgcgctgcgcgacttgaaaaaccgccgcgtcggcatggatacgccgattaccgtcgccatcatcatgacctttatcgccggcgtttacagccttgcgacaaatgcggggcaggggatgtatttcgaatccatcgcgatgctgctgtttttcctgctgggcggacgctttatggaacacattgcccgccgtaaggcaggcgatgccgccgagaggctggtgaagctgattcctgcgttttgccatcatatgcccgattaccccgatacgcaggaaacctgcgaggcagctgtcgtcaaattgaaggcgggcgatatcgtgctggtcaaaccgggcgaaaccatccccgttgacggcacggtgctggaaggaagcagtgccgtcaacgaatctatgctgaccggcgagagcctgcccgtcgccaaaatgccgtctgaaaaagtaaccgccggcacactcaacacgcaaagccccctgattatacgcaccgaccgcaccggcggcggcacgcgactgtcgcacatcgtccgcctgctcgaccgcgccttagcgcaaaaaccgcgcactgccgagttggcggaacaatacgcctcgtctttcatattcggcgaactcctgcttgccgtccccgtcttcatcggctggacgctgtacgccgacgcgcacaccgcattgtggattaccgtcgccctgctggtcattacctgcccctgcgccttatcgcttgccacgccgaccgcgctggcagcttctaccggtacgctggcgcgcgaaggtattttaatcggcggaaagcaggcaatcgaaaccctcgcccaaaccaccgacatcatcttcgacaaaaccggcacgctgacccaaggcaaacccgccgtccgccgtatctcattgttgagaggcacagacgaagcctttgttctcgcggtggcgcaggctttagaacaacagtccgaacatccccttgcccgcgccatcctcaactgccgcatttcagacggcagcgtccccgacatcgctattaaacaacgcctcaaccgcatcggcgaaggcgtgggcgcgcaactgaccgtcaacggcgaaacacaggtttgggcattgggcagggcatcctatgtcgccgaaatttcaggtaaagaaccgcaaacagaaggcggcggcagcgcggtttacctcggcagtcaaagcggtttccaagccgtgttctacctgcaagacccgctcaaagacagcgcggcggaggcggtgcggcagttggcaggcaaaaacctgacgctgcacattctcagcggcgaccgtgaaaccgccgttgccgaaaccgcacgcgccctgggtgtcgcgcactaccgcgcccaagccatgcccgaggacaaactggaatacgtcaaagccttgcaaaaagaagggaaaaaagtgctgatgataggcgacggcatcaacgacgcgcccgttttggcgcaggcagacgtatccgccgccgcagcgggcgggacggatattgcgagggacggcgcggacattgtgttattgaacgaagatttgcgtaccgtcgcccacctgctcgatcaggcgcggcgcacccgccatattatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacgggggaaaatgcagtctgaaaaaatgccgtccgaacaatga

SEQ ID NO: 41189 - protein, 823 aa, Neisseria meningitidis
MKKTCFHCGLDVPENLHLTVRYENEDRETCCAGCQAVAQSIIDAGLGSYYKQRTADAQKTELPPQEILDQIRLYDLPEVQSDFVETHGGTREAVLMLGGITCAACVWLIEQQLLRTDGIVRIDLNYSTHRCRVVWDDGKIRLSDILLKIRQIGYTAAPYDAQKIEAANQKERKQYIVRLAVAGLGMMQTMMFALPTYLYGGDIEPDFLQILHWGGFLMVLPVVFYCAVPFYQGALRDLKNRRVGMDTPITVAIIMTFIAGVYSLATNAGQGMYFESIAMLLFFLLGGRFMEHIARRKAGDAAERLVKLIPAFCHHMPDYPDTQETCEAAVVKLKAGDIVLVKPGETIPVDGTVLEGSSAVNESMLTGESLPVAKMPSEKVTAGTLNTQSPLIIRTDRTGGGTRLSHIVRLLDRALAQKPRTAELAEQYASSFIFGELLLAVPVFIGWTLYADAHTALWITVALLVITCPCALSLATPTALAASTGTLAREGILIGGKQAIETLAQTTDIIFDKTGTLTQGKPAVRRISLLRGTDEAFVLAVAQALEQQSEHPLARAILNCRISDGSVPDIAIKQRLNRIGEGVGAQLTVNGETQVWALGRASYVAEISGKEPQTEGGGSAVYLGSQSGFQAVFYLQDPLKDSAAEAVRQLAGKNLTLHILSGDRETAVAETARALGVAHYRAQAMPEDKLEYVKALQKEGKKVLMIGDGINDAPVLAQADVSAAAAGGTDIARDGADIVLLNEDLRTVAHLLDQARRTRHIIRQNLIWAGAYNIIAVPLAVLGYVQPWIAALGMSFSSLAVLGNALRLHKRGKMQSEKMPSEQ

SEQ ID NO: 41190 - DNA, 717 bp, Neisseria gonorrhoeae
gtgttcaataatttccttgcctctctgccgtttatgacggaaacacgcgctgatatgctcatcagcgcgttttggcccatggttaaagccggctttacagtgtctttgcctttggcgatcgcttctttcgttatcggcatgattattgccgtagccgttgctttggtaagaatcatgccttccggcggtattttccaaaaatgcttgttgaagctggtggaattttatatttccgtcgttcgcggtacgccgctgttggttcagcttgtgattgtgttttacgggctgccgtccgtcggcatctatatcaatccgattcccgccgccatcatcggcttttcgctcaatgtcggcgcatacgcttccgaaaccatacgcgcggcgattttgtccgtgccgaaagggcagtgggaagcaggtttctccatcggtatgacctatatgcagacgttccgccgcatcgtcgcaccgcaggcattccgcgtcgccgttccgccgttgagcaacgagtttatcggcttgttcaaaaacacctcgcttgccgccgtggtaacggtaacggagcttttccgtgtcgcacaggaaacggcaaaccgcacttatgactttttgcctgtctatatcgaagctgcattggtttattggtgtttctgtaaagtgctgtttttgattcaggcgcgtttggaaaaacgtttcgaccgttatgtcgccaaataa

SEQ ID NO: 41191 - protein, 238 aa, Neisseria gonorrhoeae
VFNNFLASLPFMTETRADMLISAFWPMVKAGFTVSLPLAIASFVIGMIIAVAVALVRIMPSGGIFQKCLLKLVEFYISVVRGTPLLVQLVIVFYGLPSVGIYINPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 41192 - DNA, 717 bp, Neisseria meningitidis
gtgttcaataatttccttgcttcgctgccgtttatgacggaaacacgcgccgatatgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatacgcttccgaaaccatacgcgcggcaattttgtccgtacctaaaggccaatgggaagcaggtttctccatcggcatgacctatatgcagacgttccgccgcattgtcgcgccgcaggcattccgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataa

SEQ ID NO: 41193 - protein, 238 aa, Neisseria meningitidis
VFNNFLASLPFMTETRADMIVSAFLPMVKAGFAVSLPLAAASFVIGMMIAVAVALVRIMPAGGIVRKILLKLVEFYISVIRGTPLLVQLVIVFYGLPSVGIYIDPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 41194 - DNA, 717 bp, Neisseria meningitidis
gtgttcaataatttccttgcttcgctgccgtttatgacggaaacacgcgccgatatgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatatgcttccgaaaccatacgcgcggcaattttgtccgtaccgaaaggccaatgggaagcaggtttctccatcggcatgacctatatgcagacgttccgccgcatcgtcgcgccgcaggcatttcgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataa

SEQ ID NO: 41195 - protein, 238 aa, Neisseria meningitidis; identical to SEQ ID NO: 41193

SEQ ID NO: 41196 - DNA, 1128 bp, Neisseria gonorrhoeae
atgaactcctcgcaacgcaaacgcctttccggccgctggctcaactcctacgaacgctaccgccaccgccgcctcatacatgccgtgcggctcggcggaaccgtcctgttcgccaccgcactcgcccggctactccacctccaacacggcgaatggatagggatgaccgtcttcgtcgtcctcggcatgctccagttccaaggcgcgatttactccaacgcggtggaacgtatgctcggtacggtcatcgggctgggcgcgggtttgggcgttttatggctgaaccagcattatttccacggcaacctcctcttctacctgaccatcggcacggcaagcgcactggccggctgggcggcggtcggcaaaaacggctacgtccctatgctggcggggctgacgatgtgcatgctcatcggcgacaacggcagcgaatggctcgacagcggcctgatgcgcgcgatgaacgtcctcatcggcgccgccatcgccattgccgccgccaaactgctgccgctgaaatccacactgatgtggcgtttcatgcttgccgacaacctggccgactgcagcaaaatgattgccgaaatcagcaacggcaggcgtatgacgcgcgaacgtttggagcagaatatggtcaaaatgcgccaaatcaacgcacgcatggtcaaaagccgcagccacctcgccgccacatcgggcgaaagccgcatcagcccctccatgatggaagccatgcagcacgcccaccgcaaaatcgtcaacaccaccgagctgctcctgaccaccgccgccaagctgcaatctcccaaactcaacggcagcgaaatccggctgctcgaccgccacttcacactgctccaaaccgacctgcaacaaaccgccgccctcatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 41197 - protein, 375 aa, Neisseria gonorrhoeae
MNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVILLQRTRRKWLDAHERQHLRQSLLETREHG

SEQ ID NO: 41198 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcagggctgacgatgtgtatgctcatcggcgacaacggcagcgaatggctcgacagcggactcatgcgcgccatgaacgtcctcatcggcgcggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagccgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 41199 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHG

SEQ ID NO: 41200 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcggggctgacgatgtgcatgctcatcggcgacaacggcagcgaatggttcgacagcggcctgatgcgcgcgatgaacgtcctcatcggcgcggccatcgccatcgccgccgccaaactgctgccgctgaaatccacactgatgtggcgtttcatgcttgccgacaacctgaccgactgcagcaaaatgattgccgaaatcagcaacggcaggcgcatgacccgcgaacgcctcgaagagaacatggcgaaaatgcgccaaatcaacgcacgcatggtcaaaagccgcagccacctcgccgccacatcgggcgaaagccgcatcagccccgccatgatggaagccatgcagcacgcccaccgtaaaattgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacagttga

SEQ ID NO: 41201 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWFDSGLMRAMNVLIGAAIAIAAAKLLPLKSTLMWRFMLADNLTDCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHS

SEQ ID NO: 41202 - DNA, 1680 bp, Neisseria meningitidis
atggaaattattaacgatgcagaacttatccgttccatgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttattttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 41203 - protein, 559 aa, Neisseria meningitidis
MEIINDAELIRSMQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFILGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 41204 - DNA, 1464 bp, Neisseria meningitidis
  misc_feature (1)..(1): n is a, c, g, or t
  misc_feature (180)..(180): n is a, c, g, or t
  misc_feature (209)..(209): n is a, c, g, or t
  misc_feature (250)..(250): n is a, c, g, or t
  misc_feature (485)..(485): n is a, c, g, or t
  misc_feature (501)..(501): n is a, c, g, or t
  misc_feature (512)..(512): n is a, c, g, or t
  misc_feature (563)..(563): n is a, c, g, or t
  misc_feature (622)..(623): n is a, c, g, or t
  misc_feature (757)..(762): n is a, c, g, or t
  misc_feature (765)..(765): n is a, c, g, or t
  misc_feature (770)..(770): n is a, c, g, or t
  misc_feature (772)..(772): n is a, c, g, or t
  misc_feature (784)..(784): n is a, c, g, or t
  misc_feature (898)..(898): n is a, c, g, or t
  misc_feature (998)..(998): n is a, c, g, or t
  misc_feature (1001)..(1001): n is a, c, g, or t
  misc_feature (1049)..(1049): n is a, c, g, or t
ntgaaagaaacagcttttaaaactgggatgtgtttaggttccaataatttgagcaggctacaaaaagccgcgcaacagatactgattgtgcgtggctacctcacttcccaagctattatccaaccacagaatatggattcgggaattctgaaattacgggtatcagcaggcgaaataggngatatccgctatgaagaaaaacgggatgngaagtctgccgagggcagtattagtgcattcaataacaaanttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgtncgataaccctttgggnttaagcgattngttttatgtttcatatggacgcggtttggtgcacaaaacggacttgactgntgccaccggtacggaaactgaaagcggatccagaagttacagcgtgcattattcggtgnncgtaaaaaaatggctgttttcttttaatcacaatggacatcgttaccacgaagcaaccgaaggctattccgtcaattacgattacaacggcaaacaatatcagagcagcctggccgccgagcgcatgctttggnnnnnnagntttcntnaaacttcagtcngaatgaaattatggacacgccaaacctataaatacatcgacgatgccgaaatcgaagtgcaacgccgccgctctgcaggctgggaagccgaattgcgccaccgtgcttacctcnaccgttggcagcttgacggcaagttgtcttacaaacgcgggaccggcatgcgccaaagtatgcccgcacctgaagaaaacggcggcggtactattccagncanatcccgtatgaaaatcataaccgccggattggatgcagcggccccgtntatgttgggcaaacagcagtttttctacgcaaccgccattcaagctcaatggaacaaaacgcctttggttgcccaagacaagttgtctatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 41205 - protein, 487 aa, Neisseria meningitidis
  misc_feature (1)..(1): Xaa can be any naturally occurring amino acid
  misc_feature (70)..(70): Xaa can be any naturally occurring amino acid
  misc_feature (84)..(84): Xaa can be any naturally occurring amino acid
  misc_feature (162)..(162): Xaa can be any naturally occurring amino acid
  misc_feature (171)..(171): Xaa can be any naturally occurring amino acid
  misc_feature (188)..(188): Xaa can be any naturally occurring amino acid
  misc_feature (208)..(208): Xaa can be any naturally occurring amino acid
  misc_feature (253)..(255): Xaa can be any naturally occurring amino acid
  misc_feature (257)..(258): Xaa can be any naturally occurring amino acid
  misc_feature (262)..(262): Xaa can be any naturally occurring amino acid
  misc_feature (300)..(300): Xaa can be any naturally occurring amino acid
  misc_feature (333)..(334): Xaa can be any naturally occurring amino acid
  misc_feature (350)..(350): Xaa can be any naturally occurring amino acid
XKETAFKTGMCLGSNNLSRLQKAAQQILIVRGYLTSQAIIQPQNMDSGILKLRVSAGEIGDIRYEEKRDXKSAEGSISAFNNKXPLYRNKILNLRDVEQGLENLRRLPSVKTDIQIIPSEEEGKSDLQIKWQQNKPIRFSIGIDDAGGKTTGKYQGNVALSXDNPLGLSDXFYVSYGRGLVHKTDLTXATGTETESGSRSYSVHYSVXVKKWLFSFNHNGHRYHEATEGYSVNYDYNGKQYQSSLAAERMLWXXXFXXTSVXMKLWTRQTYKYIDDAEIEVQRRRSAGWEAELRHRAYLXRWQLDGKLSYKRGTGMRQSMPAPEENGGGTIPXXSRMKIITAGLDAAAPXMLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 41206 - DNA, 762 bp, Neisseria gonorrhoeae
atgccttttaagccatccaaacgaatctctttattacttgttcttgccttgggcgcgtgcagcacttcctaccgcccctcgcgggcagaaaaagccaatcaggtttccaatatcaaaacccagttggcgatggaatatatgcgcggtcaggactaccgtcaggcaacggcaagtattgaagatgccttgaaatcgaaccctaaaaacgaacttgcctggctggtccgtgccgaaatctatcaatacctgaaagttaacgacaaggcgcaggaaagtttccggcaagccctctccatcaaacccgacagtgccgaaatcaacaacaactacggctggttcctgtgcggcaggctcaaccgccctgccgaatctatggcatatttcgacaaagccctggccgaccccacctacccgaccccttatattgccaacctgaataaaggtatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgtgcaggcggcatacgaatatgaagcacaattgcaggcaaatttcccctactcggaagaattgcaaaccgtcctcaccggtcaataa

SEQ ID NO: 41207 - protein, 253 aa, Neisseria gonorrhoeae
MPFKPSKRISLLLVLALGACSTSYRPSRAEKANQVSNIKTQLAMEYMRGQDYRQATASIEDALKSNPKNELAWLVRAEIYQYLKVNDKAQESFRQALSIKPDSAEINNNYGWFLCGRLNRPAESMAYFDKALADPTYPTPYIANLNKGICSAKQGQFGLAEAYLKRSLAAQPQFPPAFKELARTKMLAGQLGDADYYFKKYQSRVEVLQADDLLLGWKIAKALGNVQAAYEYEAQLQANFPYSEELQTVLTGQ

SEQ ID NO: 41208 - DNA, 762 bp, Neisseria meningitidis
atgccttttaagccatccaaacgaatctctttattactcgttcttgccttgggcgcgtgcagcacttcctaccgcccctcgcgggcagaaaaagccaatcaggtttccaatatcaaaacccagttggcaatggaatatatgcgcggtcaggactaccgtcaggcgacggcaagtattgaagacgccctgaaatcggaccctaaaaacgagcttgcctggctggtccgtgccgaaatctatcaatacctgaaagttaacgacaaggcgcaggaaagtttccggcaagccctctccatcaaacccgacagtgccgaaatcaacaacaactacggttggttcctatgcggcaggctcaaccgccctgccgaatctatggcatatttcgacaaagctctggccgaccccacctacccgaccccttatattgccaacctgaataaaggcatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgcacaggcggcatacgaatatgaagcacaattgcaggcgaatttcccctactcggaagaattgcaaaccgtcctcaccggtcaataa

SEQ ID NO: 41209 - protein, 253 aa, Neisseria meningitidis
MPFKPSKRISLLLVLALGACSTSYRPSRAEKANQVSNIKTQLAMEYMRGQDYRQATASIEDALKSDPKNELAWLVRAEIYQYLKVNDKAQESFRQALSIKPDSAEINNNYGWFLCGRLNRPAESMAYFDKALADPTYPTPYIANLNKGICSAKQGQFGLAEAYLKRSLAAQPQFPPAFKELARTKMLAGQLGDADYYFKKYQSRVEVLQADDLLLGWKIAKALGNAQAAYEYEAQLQANFPYSEELQTVLTGQ

SEQ ID NO: 41210 - DNA, 762 bp, Neisseria meningitidis
  misc_feature (164)..(164): n is a, c, g, or t
  misc_feature (287)..(287): n is a, c, g, or t
  misc_feature (331)..(331): n is a, c, g, or t
  misc_feature (408)..(408): n is a, c, g, or t
  misc_feature (416)..(416): n is a, c, g, or t
atgccttttaagccatccaaacgaatctctttattacttgtccttgccttgggcgcgtgcagcacttcctaccgcccctcgcgggcagaaaaagccaatcaggtttccaatatcaaaacccagttggcaatggaatatatgcgcggtcaggactaccgtcaggngacggcaagtattgaagacgccttgaaatcagaccctaaaaacgagcttgcctggctggtccgtgccgaaatctatcaatacctgaaagttaacgacaaggcgcaggaaagtttccggcaagncctctccatcaaacccgacagtgccgaaatcaacaacaactacngctggttcctgtgcggcaggctcaaccgccctgccgaatctatggcatatttcgacaaagccctggccgaccccacntacccgancccttatattgccaacctgaataaaggcatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgcacaggcggcatacgaatatgaagcacaattgcaggcgaatttcccctactcggaagaattgcaaaccgtcctcatcggtcaataa

SEQ ID NO: 41211 - protein, 253 aa, Neisseria meningitidis
  misc_feature (55)..(55): Xaa can be any naturally occurring amino acid
  misc_feature (96)..(96): Xaa can be any naturally occurring amino acid
  misc_feature (111)..(111): Xaa can be any naturally occurring amino acid
  misc_feature (139)..(139): Xaa can be any naturally occurring amino acid
MPFKPSKRISLLLVLALGACSTSYRPSRAEKANQVSNIKTQLAMEYMRGQDYRQXTASIEDALKSDPKNELAWLVRAEIYQYLKVNDKAQESFRQXLSIKPDSAEINNNYXWFLCGRLNRPAESMAYFDKALADPTYPXPYIANLNKGICSAKQGQFGLAEAYLKRSLAAQPQFPPAFKELARTKMLAGQLGDADYYFKKYQSRVEVLQADDLLLGWKIAKALGNAQAAYEYEAQLQANFPYSEELQTVLIGQ

SEQ ID NO: 41212 - DNA, 1380 bp, Neisseria gonorrhoeae
atgtttgctttcaaatccttactcgatatgccgcgcggtgaggcacttgccgtcgtcgtcgctctgattgccgcaatgggctataccatcatttcattggagtggctgccgcatatgtccattattgccgccatcgtcgtgctgattttgtacggcttggcgcgcggtttgaaatacaacgatatgcaggcagggatgataggcgcgttgaatcagggtatgggcgcggtttacctgtttttcttcatcgggctgatggtcagcgcgctgatgatgagcggcgcgattccgacgctgatgtattacggtttcgggctgatttccccgacttatttttatttttccgccttcgcgctgtgttccgtcatcggcgtgtccatcggcagcagcctgaccgcctgcgccactgtcggcgttgcctttatggggatggcggcggcgtttcaggccgatatggcgatgacggcgggcgcgattgtttccggtgtgtttttcggcgataaaatgtccccgctttccgacaccacgggcatttccgcgtccatcgtcggtatcgacctgtttgaacacatcaaaaacatgatgtacaccaccatccctgcgtggcttatcagcgcggcactgatgctttggcttcttcccagcgtcgccgcgcaggatttgaacagcgtcgaatccttccgcagccagcttgaagccacgggattggtgcacggctattcgctgattccgtttgcactgttggtcgttttggcattgatgcgcgtcaatgccgtggtcgccatgctctttaccgtcattgccgccgttgccgtaacgtatctgcacagcacgcccgatctgcgtcagctcggcgcgtggttttatggcggctacaaactcgaaggcgaagcgtttaaagacattgccaaactgatttcgcgcggcggcttggagagtatgttctttacgcagaccatcgttatcctcggtatgagtttgggcgggctgctgtttgcgctcggtgtgattccttccttgctggaggccgtccgtaccttcttgacgaatgccggacgcgcgacgttcagcgttgccatgacttcggtcggggtcaatttcctgattggagagcaatatttgagcatcctgctttcgggagaaacgttcaaacccgtttacgacaaactcggcctgcattcgtgcaacctgtcgcggactctggaagatgcggggacggtgattaacccgctcgtgccgtggagcgtgtgcggcgtatttatcagccacgcccttggcgtacccgtttgggaatatctgccttatgcctttttctgctatttgagtttggctttaaccctgttattcggctggacggggctgactttgagcaaaaaataa

SEQ ID NO: 41213 - protein, 459 aa, Neisseria gonorrhoeae
MFAFKSLLDMPRGEALAVVVALIAAMGYTIISLEWLPHMSIIAAIVVLILYGLARGLKYNDMQAGMIGALNQGMGAVYLFFFIGLMVSALMMSGAIPTLMYYGFGLISPTYFYFSAFALCSVIGVSIGSSLTACATVGVAFMGMAAAFQADMAMTAGAIVSGVFFGDKMSPLSDTTGISASIVGIDLFEHIKNMMYTTIPAWLISAALMLWLLPSVAAQDLNSVESFRSQLEATGLVHGYSLIPFALLVVLALMRVNAVVAMLFTVIAAVAVTYLHSTPDLRQLGAWFYGGYKLEGEAFKDIAKLISRGGLESMFFTQTIVILGMSLGGLLFALGVIPSLLEAVRTFLTNAGRATFSVAMTSVGVNFLIGEQYLSILLSGETFKPVYDKLGLHSCNLSRTLEDAGTVINPLVPWSVCGVFISHALGVPVWEYLPYAFFCYLSLALTLLFGWTGLTLSKK

SEQ ID NO: 41214 - DNA, 1380 bp, Neisseria meningitidis
atgttcgctttcaaatccttactcgatatgccgcgcggtgaggcacttgccgtcgtcgtcgctctgattgccgcgatgggctataccatcatttcattggagtggttgccgcatatgtccattattgccgccatcgtcgtgctgattttgtacggcttggcgcgcggtttgaaatacaacgatatgcagcagggcatgataggcgcgttgaatcagggtatgggcgcgatttacctgtttttcttcatcgggctgatggtcagcgcgctgatgatgagcggcgcgattccgacgctgatgtattacggtttcggactgatttccccgacttatttttatttttcctccttcgcgctgtgttccgtcatcggcgtgtccatcggcagcagcctgaccacctgcgccactgtcggcgttgcctttatggggatggcggcggcgtttcaggccgatatggcgatgacggcgggcgcgattgtttcgggcgcattttttggcgacaaaatgtccccgctttcggatacgacgggtatttccgcgtccatcgtcggcatcgacttgtttgagcacatcaaaaatatgatgtacaccaccatccccgcgtggctcattagtgcggcactgatgctttggcttttgccgaatgtcgccgcgcaggatttgaacagcgtcgaatccttccgcagccagcttgaagccacgggattggtgcacggctattcgctgattccgtttgcgctgttggtcattttggcattgatgcgcatcaacgccgtcgtcgccatgctctttaccgtcatggttgccgttgctgtaacgtatctgcacagcacgcccgatctgcgtcagctcggtgcgtggttttacggcggctacaaactcgaaggcgaagcgtttaaagatgttgtcaaactgatttcgcgcggcggtttggaaagtatgtttttcacgcaaaccatcgtgattctcgggatgagtttgggcggactgttgtttgcgctcggtgtgattccttccctgttggaggccatccgtaccttcttgacgaatgccggacgcgcgacgttcagcgttgccatgacttcggtcggggttaatttcctgatcggcgagcaatatttgagtattttgttgtcgggtgaaacgttcaaacccgtttacgataagctcggtctgcattcgcgcaatctgtcgcggacgctggaagatgcggggacggtgattaacccgctcgtaccgtggagcgtatgcggcgtgttcatcagccacgcgctgggcgtgccggtttgggaatatctgccgtatgcctttttctgctatttgagtttggctttgaccctgttattcggttggacggggctgactttgagcaaaaaataa

SEQ ID NO: 41215 - protein, 459 aa, Neisseria meningitidis
MFAFKSLLDMPRGEALAVVVALIAAMGYTIISLEWLPHMSIIAAIVVLILYGLARGLKYNDMQQGMIGALNQGMGAIYLFFFIGLMVSALMMSGAIPTLMYYGFGLISPTYFYFSSFALCSVIGVSIGSSLTTCATVGVAFMGMAAAFQADMAMTAGAIVSGAFFGDKMSPLSDTTGISASIVGIDLFEHIKNMMYTTIPAWLISAALMLWLLPNVAAQDLNSVESFRSQLEATGLVHGYSLIPFALLVILALMRINAVVAMLFTVMVAVAVTYLHSTPDLRQLGAWFYGGYKLEGEAFKDVVKLISRGGLESMFFTQTIVILGMSLGGLLFALGVIPSLLEAIRTFLTNAGRATFSVAMTSVGVNFLIGEQYLSILLSGETFKPVYDKLGLHSRNLSRTLEDAGTVINPLVPWSVCGVFISHALGVPVWEYLPYAFFCYLSLALTLLFGWTGLTLSKK

SEQ ID NO: 41216 - DNA, 1380 bp, Neisseria meningitidis
  misc_feature (13)..(13): n is a, c, g, or t
  misc_feature (45)..(45): n is a, c, g, or t
  misc_feature (95)..(96): n is a, c, g, or t
  misc_feature (138)..(138): n is a, c, g, or t
  misc_feature (237)..(237): n is a, c, g, or t
  misc_feature (423)..(423): n is a, c, g, or t
  misc_feature (432)..(434): n is a, c, g, or t
  misc_feature (436)..(436): n is a, c, g, or t
  misc_feature (446)..(446): n is a, c, g, or t
  misc_feature (451)..(451): n is a, c, g, or t
  misc_feature (453)..(453): n is a, c, g, or t
  misc_feature (458)..(458): n is a, c, g, or t
  misc_feature (460)..(461): n is a, c, g, or t
  misc_feature (463)..(464): n is a, c, g, or t
  misc_feature (466)..(467): n is a, c, g, or t
  misc_feature (470)..(470): n is a, c, g, or t
  misc_feature (472)..(473): n is a, c, g, or t
  misc_feature (480)..(482): n is a, c, g, or t
  misc_feature (485)..(485): n is a, c, g, or t
  misc_feature (492)..(492): n is a, c, g, or t
  misc_feature (495)..(495): n is a, c, g, or t
  misc_feature (500)..(500): n is a, c, g, or t
  misc_feature (510)..(510): n is a, c, g, or t
  misc_feature (526)..(526): n is a, c, g, or t
  misc_feature (534)..(534): n is a, c, g, or t
  misc_feature (591)..(591): n is a, c, g, or t
  misc_feature (617)..(619): n is a, c, g, or t
  misc_feature (632)..(632): n is a, c, g, or t
  misc_feature (896)..(896): n is a, c, g, or t
  misc_feature (899)..(899): n is a, c, g, or t
  misc_feature (1060)..(1060): n is a, c, g, or t
  misc_feature (1137)..(1137): n is a, c, g, or t
  misc_feature (1265)..(1265): n is a, c, g, or t
atgttcgctttcnaatccttactcgatatgccgcgcggtgaggcncttgccgtcgtcgtcgctctgattgccgcgatgggctataccatcatttnnttggagtggctgccgcatatgtccattattgccgccatcgtngtgctgattttgtacggcttggcgcgcggtttgaaatacaacgatatgcagcagggcatgataggcgcgttgaatcagggtatgggcgcgatttacctntttttcttcatcgggctgatggtcagcgcgctgatgatgagcggcgcgattccgacgctgatgtattacggtttcggactgatttccccgacttatttttatttttccgccttcgcgctgtgttccgtcatcggcgtgtccatcggcagcagcctgaccacctgcgccactgtcggcgttgccttnatgggtatnnngncggcgtttcnggccnanatggngnngnngnnggncnngattgtnnnggncgcattnttnggcgncaaaatgtcnccgctttccgatacgncgggcatntccgcgtccattgtcggtatcgacctgtttgaacacatcaaaaatatgatgtacacnaccattcccgcgtggctcatcagtgnnncactgatgctgtngcttcttcccagcgtcgccgcgcaggatttgaacagcgtcgaatccttccgcagccagcttgaagccacgggattggtgcactgctattcgctgattccgtttgcgctgttggtcgttttggcattgatgcgcgtcaatgccgtggtcgctatgctctttaccgtcattgccgccgttgccgtaacgtatctgcacagcacgcccgatctgcgtcagctcggcgcgtggttttacggcggctacaaactcgaaggcgaagcgtntanagacattgccaaactcatttctcgcggcggtttggaaagtatgtttttcacgcagaccatcgtgattcttgggatgagccttggcgggctgctgtttgcactgggcgcgattccttccctgctggatgccgtccgcagctttttgacgaatgccgggcgtnccacattcagcgttgccatgacttcggtcggggttaatttcctgatcggcgagcaatatttgagtattttgttgtcnggtgaaacgttcaaacctgtttacgataagctcggtctgcattcgcgcaatctgtcgcggacgctggaagatgcggggacggtcatcaacccgctcgtaccgtggagcgtatgcggcgtgttcatcanccacgcgctgggcgtgccggtttgggaatatctgccgtatgcctttttctgctatttgagtttggctttgaccctgttattcggttggacggggctgactttgagcaaaaaataa

SEQ ID NO: 41217 - protein, 459 aa, Neisseria meningitidis
  misc_feature (5)..(5): Xaa can be any naturally occurring amino acid
  misc_feature (32)..(32): Xaa can be any naturally occurring amino acid
  misc_feature (141)..(141): Xaa can be any naturally occurring amino acid
  misc_feature (144)..(146): Xaa can be any naturally occurring amino acid
  misc_feature (149)..(149): Xaa can be any naturally occurring amino acid
  misc_feature (151)..(151): Xaa can be any naturally occurring amino acid
  misc_feature (153)..(158): Xaa can be any naturally occurring amino acid
  misc_feature (161)..(162): Xaa can be any naturally occurring amino acid
  misc_feature (164)..(165): Xaa can be any naturally occurring amino acid
  misc_feature (167)..(167): Xaa can be any naturally occurring amino acid
  misc_feature (176)..(176): Xaa can be any naturally occurring amino acid
  misc_feature (178)..(178): Xaa can be any naturally occurring amino acid
  misc_feature (206)..(207): Xaa can be any naturally occurring amino acid
  misc_feature (211)..(211): Xaa can be any naturally occurring amino acid
  misc_feature (299)..(300): Xaa can be any naturally occurring amino acid
  misc_feature (354)..(354): Xaa can be any naturally occurring amino acid
  misc_feature (422)..(422): Xaa can be any naturally occurring amino acid
MFAFXSLLDMPRGEALAVVVALIAAMGYTIIXLEWLPHMSIIAAIVVLILYGLARGLKYNDMQQGMIGALNQGMGAIYLFFFIGLMVSALMMSGAIPTLMYYGFGLISPTYFYFSAFALCSVIGVSIGSSLTTCATVGVAXMGXXXAFXAXMXXXXXXIVXXAXXGXKMSPLSDTXGXSASIVGIDLFEHIKNMMYTTIPAWLISXXLMLXLLPSVAAQDLNSVESFRSQLEATGLVHCYSLIPFALLVVLALMRVNAVVAMLFTVIAAVAVTYLHSTPDLRQLGAWFYGGYKLEGEAXXDIAKLISRGGLESMFFTQTIVILGMSLGGLLFALGAIPSLLDAVRSFLTNAGRXTFSVAMTSVGVNFLIGEQYLSILLSGETFKPVYDKLGLHSRNLSRTLEDAGTVINPLVPWSVCGVFIXHALGVPVWEYLPYAFFCYLSLALTLLFGWTGLTLSKK

SEQ ID NO: 41218 - DNA, 378 bp, Neisseria meningitidis
atggaaacccacgaaaaaatccgcctgatgcgcgaattgaataaatggtcccaggaggatatggcggaaaagctggcgatgtcggcaggcgggtatgccaaaatcgaacggggcgaaacgcagttaaatatcccgcgtttggagcagttggctcagattttcaaaatcgatatgtgggacttgctcaaatcgggcggtggtgggatggtgtttcagattaatgaaggtgatagtggtggcgatattgcgttgtatgcgtcgggtgatgtttcgatgaaaatagaatttttaaaaatggagttgaaacactgcaaagaaatgttggaacaaaaagacaaagaaatcgagctgctccgcaagctgaccgaaaccgtttaa

SEQ ID NO: 41219 - protein, 125 aa, Neisseria meningitidis
METHEKIRLMRELNKWSQEDMAEKLAMSAGGYAKIERGETQLNIPRLEQLAQIFKIDMWDLLKSGGGGMVFQINEGDSGGDIALYASGDVSMKIEFLKMELKHCKEMLEQKDKEIELLRKLTETV

SEQ ID NO: 41220 - DNA, 381 bp, Neisseria meningitidis
  misc_feature (276)..(276): n is a, c, g, or t
atggaaacccacgaaaaaatccgcctgatgcgcgaattgaataaatggtcccaggaggatatggcggaaaagctggcgatgtcggcaggcgggtatgccaaaatcgaacgaggcgaaacgcagttgaatatcccgcgtttggagcagttggcgcagattttcaaaattgatatgtgggacttgctcaaatcgggcggcggcgggatggtgttgcagattaacgatgtggataccaacagcggggaatttgcaatctataccgctcaggatgcatcnggtaaagctggatttgttaaaatggaattaaaacactgtaaagaaatgttggaacacaaagacaaagaaatcgagctgctccgcaagctgaccgaaaccgtttaa

SEQ ID NO: 41221 - protein, 126 aa, Neisseria meningitidis
METHEKIRLMRELNKWSQEDMAEKLAMSAGGYAKIERGETQLNIPRLEQLAQIFKIDMWDLLKSGGGGMVLQINDVDTNSGEFAIYTAQDASGKAGFVKMELKHCKEMLEHKDKEIELLRKLTETV

SEQ ID NO: 41222 - DNA, 1296 bp, Neisseria meningitidis
atgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaatatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgctgctcggtcatcgcgctgtcggagcgggatgtggaacgccaggggcggattgttgggcaaagcacggcggacaatctggtcgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaggggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatag

SEQ ID NO: 41223 - protein, 431 aa, Neisseria meningitidis
MPAPDLGFALSLPPKKAIEWLESKKVTAESYRNLTASEIAKVYTIARMTDLDMLNDIKTSMVESAKSGQSFDDWRKGILNLLSNKGWLHPNGHNGKDIIDPATGEVFGSPRRLETIYRTNMQTAYNAGQYQGYMANIDARPYWMYDAVGDSRTRPAHSAIDGLVYRYDDPFWATFYPPNGYNCRCSVIALSERDVERQGRIVGQSTADNLVETHKIYNKKGDTYLTLAYKAPDGSLYTTDRGFDYNAGRMNYRPDLDKYDRALAHQFAKAEMGGADFKTSFKQLEKEFYEVKQRLDIDGKPDKEQKIKIRNALSRQLKFAAGVLSKETQELAGMTRATVWLSDDTLVKQVDSREGQNFDDSYYAFLPDMLQNPEHVIRDNRELIFTARYKGSALWAVLKYIKEVDEIYLQSYRISNDKEIAKFMAKKKVLK

SEQ ID NO: 41224 - DNA, 1296 bp, Neisseria meningitidis
atgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaacatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgttgctcggtcatcgcgctgtcggagcgggatgtggaacgccaggggcggattgtcgggcaaagcacgtcggacaatcttgttgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaagggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatag

SEQ ID NO: 41225 - protein, 431 aa, Neisseria meningitidis
MPAPDLGFALSLPPKKAIEWLESKKVTAESYRNLTASEIAKVYTIARMTDLDMLNDIKTSMVESAKSGQSFDDWRKGILNLLSNKGWLHPNGHNGKDIIDPATGEVFGSPRRLETIYRTNMQTAYNAGQYQGYMANIDARPYWMYDAVGDSRTRPAHSAIDGLVYRYDDPFWATFYPPNGYNCRCSVIALSERDVERQGRIVGQSTSDNLVETHKIYNKKGDTYLTLAYKAPDGSLYTTDRGFDYNAGRMNYRPDLDKYDRALAHQFAKAEMGGADFKTSFKQLEKEFYEVKQRLDIDGKPDKEQKIKIRNALSRQLKFAAGVLSKETQELAGMTRATVWLSDDTLVKQVDSREGQNFDDSYYAFLPDMLQNPEHVIRDNRELIFTARYKGSALWAVLKYIKEVDEIYLQSYRISNDKEIAKFMAKKKVLK

SEQ ID NO: 41226 - DNA, 1413 bp, Neisseria meningitidis
atgatgccccatattgattttgacacgattccgggcagcatccgcgtgcccgggcagtatattgaatttaacacccgcaatgccgtacaaggtttgccgcaaaatccgcaaaaggtattgatggttgcacccatgctgaccgcgggcatacagcccgccttagagccggtgcaactatttagcgatgccgaggcggccgatttgttcggacaaggctcgctggcgcatttgatggtgcgccaagcatttgccaacaacccttatttggatttgaccgttatcggtattgccgaccacagcgcaggcgtgcaggcaaccgcaaccgttaccctttccggcacggccaccgcgccgggcgtggtggaaatcacgattggcggcaagcaggtaagcacggccgttaacaccggcgagaccgccgccacagtggcagaccgtctgaaaaccgccatcactgccgccgatgtaaccgttaccgcatccggcagcggcgcagccgttacgctgacggccaaacacaaaggcgagatcggcaacgagagcggcttaaccgtgagcaccggcaataccggcctaacttatcaagccaatgcctttaccggcggtgccaaaaatgcggacattgccacggccttgtccaaagtggcgggcaagcattatcacattatttgcagcccgtttagcgatgacgccaacgccaaagccttgagcaaccatattaccaacgtatccaacgccatcgagcagcgcggctgtatcggcgtattgggtatgagtgcggccttgagcacggccaccaccgctaccggcgaaatcaacgacggccgcatgacctgtgcttggtacaaaggtgcggtagagccaaacggcatcatcgccgcaggttatgcggcggtgttggcctttgaagaagaccctgccaagccgctgaacacgctggaaatcaaagggctggccgttacacctgatgcgcaatggccgctgtttgcagaatgcaacaatgcgctgtacaacggcttgaccccgctcacagtggtcaacaaccgcgtgcagattatgcgtgccgtatccacctataccaagtcggccaacaacaccgacgacccggcactactcgacattaccaccatccgcacgctggattatgtgcgccgcagcgttaaagagcgcattgccctgcgttttccgcgcgacaaattgagcgaccgcctgctgcccaaggttaagagcgagattttggacgtgctgattaagctcgaccaagccgaaatcatcgaaaacgccgaggccaacaaaggcaagctggtggtggcgcgtgcgcaaaacgaccccaaccgtgttaatgccattatccccgccgatgtggtcaacggcctgcacgtctttgccgggcgcattgatttgattttgtaa

SEQ ID NO: 41227 - protein, 470 aa, Neisseria meningitidis
MMPHIDFDTIPGSIRVPGQYIEFNTRNAVQGLPQNPQKVLMVAPMLTAGIQPALEPVQLFSDAEAADLFGQGSLAHLMVRQAFANNPYLDLTVIGIADHSAGVQATATVTLSGTATAPGVVEITIGGKQVSTAVNTGETAATVADRLKTAITAADVTVTASGSGAAVTLTAKHKGEIGNESGLTVSTGNTGLTYQANAFTGGAKNADIATALSKVAGKHYHIICSPFSDDANAKALSNHITNVSNAIEQRGCIGVLGMSAALSTATTATGEINDGRMTCAWYKGAVEPNGIIAAGYAAVLAFEEDPAKPLNTLEIKGLAVTPDAQWPLFAECNNALYNGLTPLTVVNNRVQIMRAVSTYTKSANNTDDPALLDITTIRTLDYVRRSVKERIALRFPRDKLSDRLLPKVKSEILDVLIKLDQAEIIENAEANKGKLVVARAQNDPNRVNAIIPADVVNGLHVFAGRIDLIL

SEQ ID NO: 41228 - DNA, 1146 bp, Neisseria meningitidis
atgcaaaataattcatacggctatgccgtgtcggtgcgcgtgggcggtaaagagcaccgccactgggagcgctacgacatcgacagcgactttttaatccctgccgacagcttcgattttgtcatcggcaggttgggaccggaggcggccatacccgatttaagcggagagagctgcgaggtagtgatagacgggcaaatcgtgatgacgggcatcatcggcagccagcgccacggcaaaagcaagggcagccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggccgaaaacaaccccgctttgggcaaaatcgacatcgagccgggcgaaaccgtatggcaggcattaacccatattgccaactcggtcgggctgcatccgtggctggagccggacggcacgttggtggtgggcggtgcggattacagcagcccgccggtggcgacattgtgttggagccgcaccgacagccgctgcaatatcgagcgcatggacattgagtgggataccgacaaccgcttttccgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggcctgcgtgtgcatgtgatcgacgacgagcacggtatcgatgcggtgttttttctgatggggcggcggtttatgctatcccgcatggatggtacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatga

SEQ ID NO: 41229 - protein, 381 aa, Neisseria meningitidis
MQNNSYGYAVSVRVGGKEHRHWERYDIDSDFLIPADSFDFVIGRLGPEAAIPDLSGESCEVVIDGQIVMTGIIGSQRHGKSKGSRELSLSGRDLAGFLVDCSAPQLNVKGMTVLDAAKKLAAPWPQIKAVVLKAENNPALGKIDIEPGETVWQALTHIANSVGLHPWLEPDGTLVVGGADYSSPPVATLCWSRTDSRCNIERMDIEWDTDNRFSEVTFLAQSHGRSGDSAKHDLKWVYKDPTMTLHRPKTVVVSDADNLAALQKQAKKQLADWRLEGFTLTITVGGHKTRDGVLWQPGLRVHVIDDEHGIDAVFFLMGRRFMLSRMDGTQTELRLKEDGIWTPDAYPKKAEAARKRKGKRKGVSHKGKKGGKKQAETAVFE

SEQ ID NO: 41230 - DNA, 1146 bp, Neisseria meningitidis
atgcaaaataattcatacggctatgccgtgtcggtgcgcgtgggcggtaaagagcaccgccactgggagcgctacgacatcgacagcgactttttaatccctgccgacagcttcgattttgtcatcggcaggttggggccggaggcggccatacccgatttaagcggagagagctgcgaggtagtgatagacgggcaaatcgtgatgacgggcatcatcggcagccagcgccacggcaaaagcaagggcggccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggtcgaaaacaaccccgctttggacaaaatcgacatcgagccgggcgaaaccgtatggcaggcattaacccatattgccaactcggtcgggctgcatccgtggctggagccggacggcacgttggtggtgggcggtgtggattacagcagcccgccggtggcgacattgtgttggagccgcaccgacagccgccgcaatatcgagcgcatggacattgagtgggataccgacaaccgcttttctgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggccagcgtgtgcatgtgatcgacgacgagcacggtatcgatgcggtgttttttctgatggggcggcggtttatgctatctcgcatggatggcacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatga

SEQ ID NO: 41231 - protein, 381 aa, Neisseria meningitidis
MQNNSYGYAVSVRVGGKEHRHWERYDIDSDFLIPADSFDFVIGRLGPEAAIPDLSGESCEVVIDGQIVMTGIIGSQRHGKSKGGRELSLSGRDLAGFLVDCSAPQLNVKGMTVLDAAKKLAAPWPQIKAVVLKVENNPALDKIDIEPGETVWQALTHIANSVGLHPWLEPDGTLVVGGVDYSSPPVATLCWSRTDSRRNIERMDIEWDTDNRFSEVTFLAQSHGRSGDSAKHDLKWVYKDPTMTLHRPKTVVVSDADNLAALQKQAKKQLADWRLEGFTLTITVGGHKTRDGVLWQPGQRVHVIDDEHGIDAVFFLMGRRFMLSRMDGTQTELRLKEDGIWTPDAYPKKAEAARKRKGKRKGVSHKGKKGGKKQAETAVFE

SEQ ID NO: 41232 - DNA, 561 bp, Neisseria meningitidis
atgagctatcaagacatcttgcggggcctgttgccccccgtgtcgtatgcccgcaatgccccgcgtgtgcgggcgcaggcagaaatagacggcgcagcgctggatgcggtggcggaatcggctcaaagcgttgccgatgccgtcgacccgcgcagcgccggccaaatgctggccgattgggagcgcgtattaggtttggacggtacgggcaaaaaccgccagcaccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgctaa

SEQ ID NO: 41233 - protein, 186 aa, Neisseria meningitidis
MSYQDILRGLLPPVSYARNAPRVRAQAEIDGAALDAVAESAQSVADAVDPRSAGQMLADWERVLGLDGTGKNRQHRVLAVMAKLNETGGLSIPYFVRLAEAAGYQIQIDEPQPFRAGVNRAGDRLAPQEIMWVWHVNVRGGNNRITRFRAGISAAGDRLTDYSDAVIESLFNRLKPAHTAIRFTYR

SEQ ID NO: 41234 - DNA, 561 bp, Neisseria meningitidis
atgagctatcaagacatcttgcggggtctgttgccccccgtgtcgtatgcccgcaatgccccgcgtgtgcgggcgcaggcagaaatagacggcgcagcgctggatgcggtggcggaatcggctcaaagcgttgccgatgccgtcgacccgagcagcgccggccaaatgctggccgattgggagcgcgtattaggtttggacggtacgggcaaaaaccgccagcgccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgataa

SEQ ID NO: 41235 - protein, 186 aa, Neisseria meningitidis
MSYQDILRGLLPPVSYARNAPRVRAQAEIDGAALDAVAESAQSVADAVDPSSAGQMLADWERVLGLDGTGKNRQRRVLAVMAKLNETGGLSIPYFVRLAEAAGYQIQIDEPQPFRAGVNRAGDRLAPQEIMWVWHVNVRGGNNRITRFRAGISAAGDRLTDYSDAVIESLFNRLKPAHTAIRFTYR

SEQ ID NO: 41236 - DNA, 417 bp, Neisseria meningitidis
atgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatgggttgggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtga

SEQ ID NO: 41237 - protein, 138 aa, Neisseria meningitidis
MIDVKIDNIFVVLNQIERLGNGIENRYLLMRRLSETMHTAVKLNFRYAGRPKWVGLKYRDGKPLSDSGRLKDSFSTLSDNDTALVGTNIVYAAIHNFGGMAGRNRKVRIPQREFLTLTDDDKQALMDDVQDYFSGLIP

SEQ ID NO: 41238 - DNA, 417 bp, Neisseria meningitidis
atgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatggttggggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtga

SEQ ID NO: 41239 - protein, 138 aa, Neisseria meningitidis
MIDVKIDNIFVVLNQIERLGNGIENRYLLMRRLSETMHTAVKLNFRYAGRPKWLGLKYRDGKPLSDSGRLKDSFSTLSDNDTALVGTNIVYAAIHNFGGMAGRNRKVRIPQREFLTLTDDDKQALMDDVQDYFSGLIP

SEQ ID NO: 41240 - DNA, 339 bp, Neisseria gonorrhoeae
atgaacaaaaatattgctgccgcactcgccggtgctttatccctgtctctggccgccggcgccgttgccgcccacaaaccggcaagcaacgcaacaggcgttcaaaaatccgcccaaggctcttgcggcgcatccaaatctgccgaaggttcgtgcggcgcatccaaatctgccgaaggttcgtgcggcgcggctgcttctaaagcaggcgaaggcaaatgcggcgagggcaaatgcggtgcaactgtaaaaaaagcccacaaacacaccaaagcatctaaagccaaagccaaatctgccgaaggcaaatgcggcgaaggcaaatgcggttctaaataa

SEQ ID NO: 41241 - protein, 112 aa, Neisseria gonorrhoeae
MNKNIAAALAGALSLSLAAGAVAAHKPASNATGVQKSAQGSCGASKSAEGSCGASKSAEGSCGAAASKAGEGKCGEGKCGATVKKAHKHTKASKAKAKSAEGKCGEGKCGSK

SEQ ID NO: 41242 - DNA, 309 bp, Neisseria meningitidis
atgaacaaaaacattgctgccgctctcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataa

SEQ ID NO: 41243 - protein, 102 aa, Neisseria meningitidis
MNKNIAAALAGALSLSLAAGAVAANKPASNATGVHKSAHGSCGASKSAEGSCGAAGSKAGEGKCGEGKCGATVKKTHKHTKASKAKAKSAEGKCGEGKCGSK

SEQ ID NO: 41244 - DNA, 309 bp, Neisseria meningitidis
atgaacaaaaacattgctgccgcactcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataa

SEQ ID NO: 41245 - protein, 102 aa, Neisseria meningitidis; identical to SEQ ID NO: 41243

SEQ ID NO: 41246 - DNA, 1422 bp, Neisseria gonorrhoeae
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcgggactgacggtgtcggtattgtgcctcgggctggatcaggcatacgtccgcgaatactatgccgccgccgacaaagacactttgttcaaaaccctgttcctgccgccgctgctgttttccgccgcgatagccgccctgctgctttcccgcccgtccctgccgtctgaaatcctgttttcgctcgacgatgccgccgccggcatcgggctggtgctgtttgaactgagcttcctgcccatccgctttctcttactggttttgcgtatggaagggcgcgcccttgccttttcgtccgcgcaactcgtgcccaaactcgccattctgctgctgttgccgctgacggtcgggctgctgcactttccggcgaacacctccgtcctgaccgccgtttacgcgctggcaaaccttgccgccgccgcctttttgctgtttcaaaaccgatgccgtctgaaggccgtccggcgcgcgccgttttcgcccgccgtcctgcaccgggggctgcgctacggcataccgctcgcactgagcagccttgcctattgggggctggcatccgccgaccgtttgttcctgaaaaaatatgcgggcctggaacagctcggcgtttattcgatgggtatttcgttcggcggggcggcattattgctccaaagcatcttttcaacggtctggacaccgtatattttccgtgcaatcgaagaaaacgccacgcccgcccgcctctcggcaacggcagaatccgccgccgccctgcttgcctccgccctctgcctgaccggaattttctcgcccctcgcctccctcctgctgccggaaaactacgccgccgtccggtttaccgtcgtatcgtgtatgctgccgccgctgttttacacgctgaccgaaatcagcggcatcggtttgaacgtcgtccgcaaaacgcgtccgatcgcgcttgccaccttgggcgcgctggcggcaaacctgctgctgctggggcttgccgtaccgtccggcggcacgcgcggcgcggcggttgcctgtgccgcctcattctggttgttttttgttttcaagacagaaagctcctgccgcctgtggcagccgctcaaacgcctgccgctttatatgcacacattgttctgcctggcctcctcggcggcctacacctgcttcggcacaccggcaaactaccccctgtttgccggcgtatgggcggcatatctggcaggctgcatcctgcgccaccggaaaaatttgcacaaactgtttcattatttgaaaaaacaaggtttcccattatga

SEQ ID NO: 41247 - protein, 473 aa, Neisseria gonorrhoeae
MDTKEILGYAAGSIGSAVLAVIILPLLSWYFPADDIGRIVLMQTAAGLTVSVLCLGLDQAYVREYYAAADKDTLFKTLFLPPLLFSAAIAALLLSRPSLPSEILFSLDDAAAGIGLVLFELSFLPIRFLLLVLRMEGRALAFSSAQLVPKLAILLLLPLTVGLLHFPANTSVLTAVYALANLAAAAFLLFQNRCRLKAVRRAPFSPAVLHRGLRYGIPLALSSLAYWGLASADRLFLKKYAGLEQLGVYSMGISFGGAALLLQSIFSTVWTPYIFRAIEENATPARLSATAESAAALLASALCLTGIFSPLASLLLPENYAAVRFTVVSCMLPPLFYTLTEISGIGLNVVRKTRPIALATLGALAANLLLLGLAVPSGGTRGAAVACAASFWLFFVFKTESSCRLWQPLKRLPLYMHTLFCLASSAAYTCFGTPANYPLFAGVWAAYLAGCILRHRKNLHKLFHYLKKQGFPL

SEQ ID NO: 41248 - DNA, 1422 bp, Neisseria meningitidis
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgctgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggctgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgcccgcctctcggcaacggcagaatccgccgccgccctgcttgcctccgccctctgcctgaccggcattttctcgccccttgcctccctcctgctgccggaaaactacgccgccgtccggtttatcgtcgtatcgtgtatgctgccgccgctgttttgcacgctggcggaaatcagcggcatcggtttgaacgtcgtccgcaaaacgcgcccgatcgcgctcgccaccttgggcgcgctggcggcaaacctgctgctgctggggcttgccgtgccgtccggcggcgcgcgcggcgcggcggttgcctgtgccgcctcattctggctgttttttgccttcaagaccgaaagctcctgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatga

SEQ ID NO: 41249 - protein, 473 aa, Neisseria meningitidis
MDTKEILGYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLLPLTVGLLHFPANTAVLTAVYALANLAAAAFLLFQNRCRLKAVRHAPFSPAVLHRGLRYGIPIALSSIAYWGLASADRLFLKKYAGLEQLGVYSMGISFGGAALLFQSIFSTVWTPYIFRAIEENAPPARLSATAESAAALLASALCLTGIFSPLASLLLPENYAAVRFIVVSCMLPPLFCTLAEISGIGLNVVRKTRPIALATLGALAANLLLLGLAVPSGGARGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 41250 - DNA, 1422 bp, Neisseria meningitidis
atggacacaaaagaaatcctcggctacgcggcaggctcgatcggcagcgcggttttagccgtcatcatcctgccgctgctgtcgtggtatttccctgccgacgacatcggacgcatcgtgctgatgcagacggcggcggggctgacggtgtcggtgttgtgcctcgggctggatcaggcatacgtccgcgaatactatgccgccgccgacaaagacactttgttcaaaaccctgttcctgccgccgctgctgtctgccgccgcgatagccgccctgctgctttcccgcccatccctgccgtctgaaatcctgttttcgctcgacgatgccgccgccggcatcgggctggtgctgtttgaactgagcttcctgcccatccgctttctcttactggttttgcgtatggaaggacgcgcccttgccttttcgtccgcgcaactcgtgtccaagctcgccatcctgctgctgctgccgctgacggtcgggctgctgcactttccggcgaacaccgccgtcctgaccgccgtttacgcgctggcaaaccttgccgccgccgcctttttgctgtttcaaaaccgatgccgtctgaaggccgtccggcgcgcaccgttttcatccgccgtcctgcatcgcggcctgcgctacggcataccgatcgcactaagcagcatcgcctattgggggctggcatccgccgaccgtttgttcctgaaaaaatatgccggcctagaacagctcggcgtttattcgatgggtatttcgttcggcggagcggcattattgttccaaagcatcttttcaacggtctggacaccgtatattttccgcgcaatcgaagcaaacgccccgcccgcccgcctctcggcaacggcagaatccgccgccgccctgcttgcctccgccctctgcctgaccggcattttctcgcccctcgcctccctcctgctgccggaaaactacgccgccgtccggtttatcgtcgtatcgtgtatgctgcctccgctgttttgcacgctggtagaaatcagcggcatcggtttgaacgtcgtccgaaaaacacgcccgatcgcgctcgccaccttgggcgcgctggcggcaaacctgctgctgctggggcttgccgtaccgtccggcggcgcgcgcggcgcggcggttgcctgtgccgcctcattttggctgttttttgttttcaagaccgaaagctcctgccgcctgtggcagccgctcaaacgcctgccgctttatatgcacacattgttctgcctggcctcctcggcggcctacacctgcttcggcactccggcaaactaccccctgtttgccggcgtatgggcggtatatctggcaggctgcatcctgcgccaccggaaagatttgcacaaactgtttcattatttgaaaaaacaaggtttcccattatga

SEQ ID NO: 41251 - protein, 473 aa, Neisseria meningitidis
MDTKEILGYAAGSIGSAVLAVIILPLLSWYFPADDIGRIVLMQTAAGLTVSVLCLGLDQAYVREYYAAADKDTLFKTLFLPPLLSAAAIAALLLSRPSLPSEILFSLDDAAAGIGLVLFELSFLPIRFLLLVLRMEGRALAFSSAQLVSKLAILLLLPLTVGLLHFPANTAVLTAVYALANLAAAAFLLFQNRCRLKAVRRAPFSSAVLHRGLRYGIPIALSSIAYWGLASADRLFLKKYAGLEQLGVYSMGISFGGAALLFQSIFSTVWTPYIFRAIEANAPPARLSATAESAAALLASALCLTGIFSPLASLLLPENYAAVRFIVVSCMLPPLFCTLVEISGIGLNVVRKTRPIALATLGALAANLLLLGLAVPSGGARGAAVACAASFWLFFVFKTESSCRLWQPLKRLPLYMHTLFCLASSAAYTCFGTPANYPLFAGVWAVYLAGCILRHRKDLHKLFHYLKKQGFPL

SEQ ID NO: 41252 - DNA, 1143 bp, Neisseria meningitidis
tcagacggcctttacgtaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctga

SEQ ID NO: 41253 - protein, 380 aa, Neisseria meningitidis
SDGLYVPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGTTATSNPFLQMADWCEKSAARLILGQTLTSGADGKSSTNALGNIHNEVRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 41254 - DNA, 1581 bp, Neisseria meningitidis
atggagccgataatggcaaaaaagaacaataaaactaaaatccaaaagcccgaagctgcattgcagacggacgtggctcaaattacagcgaccggtcgagttatcgccgagcatccatccaattttattacgccgcaaaagatgcgcgccctcttcgaggacgcagaaagcggtgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatcgagctgcacaacgcggcaaacggcatgacttccgccggcaatccgtttttgcagatggccgactggtgcgaaaaatcggcggcgcggctgattttggggcaaacgctaaccagcggtgcggacggaaaatccagcaccaacgcgctgggcaatatccacaacgagatacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctga

SEQ ID NO: 41255 - protein, 526 aa, Neisseria meningitidis
MEPIMAKKNNKTKIQKPEAALQTDVAQITATGRVIAEHPSNFITPQKMRALFEDAESGDIRAQHELFADIEERDSDIAANMGTRKRALLTLNWRVAPPRNATPEEEKLSDQAYEMMDSLPTLEDLIMDLMDAVGHGFSALEVEWVFSDGLYLPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGMTSAGNPFLQMADWCEKSAARLILGQTLTSGADGKSSTNALGNIHNEIRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 41256 - DNA, 1581 bp, Neisseria meningitidis
atggagccgataatggcaaaaaagaacaataaaactaaaatccaaaagcccgaagctgcattgcagacggacgtggctcaaattacggcgaccggtcgggttatcgccgagcatccgtccaattttattacgccgcaaaagatgcgggccctcttcgaggacgcagaaagcggcgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctga

SEQ ID NO: 41257 - protein, 526 aa, Neisseria meningitidis
MEPIMAKKNNKTKIQKPEAALQTDVAQITATGRVIAEHPSNFITPQKMRALFEDAESGDIRAQHELFADIEERDSDIAANMGTRKRALLTLNWRVAPPRNATPEEEKLSDQAYEMMDSLPTLEDLIMDLMDAVGHGFSALEVEWVFSDGLYLPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGTTATSNPFLQMADWCEKSAARLILGQTLTSGADGKSSTNALGNIHNEVRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 41258 - DNA, 1581 bp, Neisseria meningitidis; identical to SEQ ID NO: 41254

SEQ ID NO: 41259 - protein, 526 aa, Neisseria meningitidis; identical to SEQ ID NO: 41255

SEQ ID NO: 41260 - DNA, 2172 bp, Neisseria meningitidis
atggcaaacgggaacatgaaactgtcgttggtgttaaccgcccgagatgacggagcgagacggctactggctgatactcaacgacaattagatcgtaccgcgaaatcgcgggcgcaacttgaacggcaaagccatacttatgcgttgaccggcatccgctcagaaaaacagattcaacgcgaaatcatgctgacacaggctgcgtttaaccgtttggcgcgcagcggcaaggcatcacaaaatgatttggcacgggcggcggtcgctacgcgtaaccgaattcgcgagctgaacgcggaactgaaacagggcacgggatttgcggacaagatgggaaaaatcggaagattcggtgcagctgcggtggctggtggcgcggcagcgtatacggtgcttaagcctgctatggacaacagaaagcagcttgatgagaacatcaaccgcgtgtccagacaggcatttattgaggataacagtaaatcggcagcgtggattgcaactgaaggtgcgcaacagatcaaggatttggcacttgaacttgtcgagaaaaatggcgggacccacgataaggctttggatttaatcagcggcatgatgaccaccggtctgaattttgcccaaaccaagaatgaagcgcaggcggcatatgcttttgcacttgcctcagaaggcagtggcgaggatacggcaaaactgattaaaaccctgaaagatggcggcatgagcggtaaagacctgcaactcgggcttgagcacgtcttgcaatcgggtttagacggcactttcgaggtgcgggatatggttcgggagctgccgagcctgctctctgccgcgcaacaggcagggatgaatggtgtcggcggtttggactacctgctctcactcttacaatctgcggcgaataaatcgggcagtcctgccgaagcggcgactaatgtgcaaaatcttttgagtaaaactctgtcgcctgacacgataggtcgtctgaagaagatggcaaatccgaatgacccgaagaaaggtgtcgattggataggctcggttgtgcaaggcaagcaaaacggcgaaaacgcagtgcaggtgttgtcccgtcttgccgatgccatgctagtaaaggataagcaataccaagattataagaaacgcgcggctgcaggcgataagacggcggcggagcaggcaaatatgcttaagggcgcgcttttggcgcaactgctgcctgatttgcaggcaaaacaaggtttgctggctgcaacggatatgacgcaaatccgtgaatatatggcttcgttggctggcgtaacgttggataacggaaaaattgctaagaacaacgaggcgcgaatgttgtcggcagcggcgcaacaagagcaacaggaatcgctggcaatgttgcgggaaagtctgacgggaacattggtggatatggaaacctcgtttaaaaagctggcagcggaataccctaatgccactctagccctgcaagcattgacgacggcggcaacagcggcgtctgccgcaatgttattaaccgccggtggcggtaaaggtgcaggctttctgaaagatgtaggtagtaaagcgttgggatggggtaaggcttccgcaggcggcgtggcagcaggtgccacagcggcaggcggtaagttgctgtcatggggaaaatctgccggtagcgggctcatgaataatccagcgttagttaaacgggcgggtttgttaggtatgttgctgtattccgagtctttgggtgacggcacattgccaaagggtttgcgtggtaccaagacaactcctgaaatgattaatcgtctgaaaaacaacggtatccgatttgaacctgcgccgaagcgggaacaggcgcggggtggtgtccctcagtatttggctgctccgtcagcgcagcctaccgataagatgttgtctccgttgttttcaactcagacggcggcgtatcaggcagccattcagcagcagacggcggcgtatcaggcagcattggcgcaggatacggctgcagttacaacaggtttggcacaagtgcaaagtgcgatggcgtcggcaagtcagaccatcaataccaatgtgagcctgaatatcgacggacgtgttatcgcgaatgaggtatcgcggtatcaagtggccatgttcggccgtggagcgggtcaataa

SEQ ID NO: 41261 - protein, 723 aa, Neisseria meningitidis
MANGNMKLSLVLTARDDGARRLLADTQRQLDRTAKSRAQLERQSHTYALTGIRSEKQIQREIMLTQAAFNRLARSGKASQNDLARAAVATRNRIRELNAELKQGTGFADKMGKIGRFGAAAVAGGAAAYTVLKPAMDNRKQLDENINRVSRQAFIEDNSKSAAWIATEGAQQIKDLALELVEKNGGTHDKALDLISGMMTTGLNFAQTKNEAQAAYAFALASEGSGEDTAKLIKTLKDGGMSGKDLQLGLEHVLQSGLDGTFEVRDMVRELPSLLSAAQQAGMNGVGGLDYLLSLLQSAANKSGSPAEAATNVQNLLSKTLSPDTIGRLKKMANPNDPKKGVDWIGSVVQGKQNGENAVQVLSRLADAMLVKDKQYQDYKKRAAAGDKTAAEQANMLKGALLAQLLPDLQAKQGLLAATDMTQIREYMASLAGVTLDNGKIAKNNEARMLSAAAQQEQQESLAMLRESLTGTLVDMETSFKKLAAEYPNATLALQALTTAATAASAAMLLTAGGGKGAGFLKDVGSKALGWGKASAGGVAAGATAAGGKLLSWGKSAGSGLMNNPALVKRAGLLGMLLYSESLGDGTLPKGLRGTKTTPEMINRLKNNGIRFEPAPKREQARGGVPQYLAAPSAQPTDKMLSPLFSTQTAAYQAAIQQQTAAYQAALAQDTAAVTTGLAQVQSAMASASQTINTNVSLNIDGRVIANEVSRYQVAMFGRGAGQ

SEQ ID NO: 41262 - DNA, 1332 bp, Neisseria meningitidis
atgagcggatggcataccttattgcaggacgcatcttacaagggcgtcggctttgatattgaggtggtggacgagagcaacggcaaggcattggccgagcatgcgcggccgtttgtgcagggtatcgaccttgaagacatgggcatgaccgggcggcaggtgcagattaatgcggtgttttggggcaagggctatgcaggccgtctgaaaaagctgctggatgcgctggagcagccgggcggcggcgtgctggtgcaccctgtttgggggcggatgcacaacatgattgcggcatcatggagttaccgacatgaggccgattatgtggattatgcgggcatcgatattactttccgcgaggcggccgaagcgcaggaaatctttgtttttgaaaacgcctttttggtcgagcttgaggcgttgattgctaatatcgacacctaccgcgaggcggctatcggctttgttgatgcggtgttggcggtggatgcgggcgtatcagctttatggggcagcgcgctgggcatttggagtgcggcatcgggtacgtttggcgcggtgcgccgtttgtttgatttggacaaaattgcctttcccgatcggggcggatacagtgcagcggcgtttaaaaacggctcggccaagctgtttgcggatatatcggtcatggtagatactggcatacgccgtgaggcgggtttggccgataatgccatgcaccatgccggttggtcgccgcgacagcggtttgacggggctgcggctgttgccgaccgcgccgccgctatccctgataatttgctgaccggccgcttttcagacggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttgcgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataa

SEQ ID NO: 41263 - protein, 443 aa, Neisseria meningitidis
MSGWHTLLQDASYKGVGFDIEVVDESNGKALAEHARPFVQGIDLEDMGMTGRQVQINAVFWGKGYAGRLKKLLDALEQPGGGVLVHPVWGRMHNMIAASWSYRHEADYVDYAGIDITFREAAEAQEIFVFENAFLVELEALIANIDTYREAAIGFVDAVLAVDAGVSALWGSALGIWSAASGTFGAVRRLFDLDKIAFPDRGGYSAAAFKNGSAKLFADISVMVDTGIRREAGLADNAMHHAGWSPRQRFDGAAAVADRAAAIPDNLLTGRFSDGLQNRLNRLTAKQVQPVAQAVRLLSTSSLLSVATALIEAHGEEMTAPDLIEVNRAMRRRMQAEIAALRAVQTAAAESGGLTANAVYTEAYQTAESLRAAAGRLNALVAAVINQKPPLIVRQAPIDGTIHQIAHEFYGDIARAAELVRLNPHIHHPAFIKRGTLVNSYAK

SEQ ID NO: 41264 - DNA, 510 bp, Neisseria meningitidis
ggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttacgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataa

SEQ ID NO: 41265 - protein, 169 aa, Neisseria meningitidis
GLQNRLNRLTAKQVQPVAQAVRLLSTSSLLSVATALIEAHGEEMTAPDLIEVNRAMRRRMQAEIAALRAVQTAAAESGGLTANAVYTEAYQTAESLRAAAGRLNALVAAVINQKPPLIVRQAPIDGTIHQIAHEFYGDIARAAELVRLNPHIHHPAFIKRGTLVNSYAK

SEQ ID NO: 41266 - DNA, 1062 bp, Neisseria meningitidis
atgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacaccagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcgacctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcaaaaggcgtattgaaacagccgggcggcttggcatttttgaccggctttattgaaaacgcccagccggtcgctgcactggcaggctcgcaaacgggcggcaaagcacccgacgaacgcgtcgccgcactgactgcggaagaggcagccgcagcaaaaatgctgggcatgtccggcgaagaatttgtaaaaatcaaagaaagcgaaggtaagtaa

SEQ ID NO: 41267 - protein, 353 aa, Neisseria meningitidis
MSKNAQKTLLAVCSFEVQPKDGRIQLLPYGEFRAVDGRPTDVPAWYLTEENGHDVALLANSSRNQLVVDYEHQTLYKEKNGQPAPAAGWMRWLEFTPKGMFAEVEWTDKAAAAIAAKEYRYISAVFSYDTKGYVSKIFHAALTNFPALDGMDEVLAAASAQILKPETEQNPMKELLQQLFDLPDAGEEELKAALSALVEAKPKDVALSADVFAQLAEKDSRIAALTAQTAKPDLTKYAPISVVQELQSKVAALTAKQEADKGNELITAALTSGKLLPAQKEWAKGVLKQPGGLAFLTGFIENAQPVAALAGSQTGGKAPDERVAALTAEEAAAAKMLGMSGEEFVKIKESEGK

SEQ ID NO: 41268 - DNA, 1062 bp, Neisseria meningitidis
atgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacactagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcggtctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcagaaggcgtattgaaacagccgggcggcttggcatttttgaccggctttattgaaaacgcccagccggtcgctgcactggcaggctcgcaaacgggcggtaaagcacccgacgaacgcgtcgccgcactgactgcggaagaggcagccgcagcaaaaatgctgggcatgtccggcgaagaatttgtaaaaatcaaagaaagcgaaggtaagtaa

SEQ ID NO: 41269 - protein, 352 aa, Neisseria meningitidis
MSKNAQKTLLAVCSFEVQPKDGRIQLLPYGEFRAVDGRPTDVPAWYLTEENGHDVALLANSSRNQLVVDYEHTLYKEKNGQPAPAAGWMRWLEFTPKGMFAEVEWTDKAAAAIAAKEYRYISAVFSYDTKGYVSKIFHAALTNFPALDGMDEVLAAASAQILKPETEQNPMKELLQQLFGLPDAGEEELKAALSALVEAKPKDVALSADVFAQLAEKDSRIAALTAQTAKPDLTKYAPISVVQELQSKVAALTAKQEADKGNELITAALTSGKLLPAQKEWAEGVLKQPGGLAFLTGFIENAQPVAALAGSQTGGKAPDERVAALTAEEAAAAKMLGMSGEEFVKIKESEGK

SEQ ID NO: 41270 - DNA, 1056 bp, Neisseria meningitidis
gtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgagccgccgcaatcctaccacggccagcggcacgctgaccgtaagcggtattgcgcaatccatgctttcagacgacctgcaagtgcgtatcggccagcgtttttaccgcactaccgcccgcgccgttatcggcagcggcggcacggcggaaataccggcaatcgccgacgagccgggcgcggccgccaatgtgggcgacggcgaggcgcaactgatggccgcccccgccggtgtggccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgtcgtcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggtatcgacttggacgaggccaagcgccgcatacggacggccctaaaagaatatttcgacaccctgatccccggcgacggcctgactgtgtcgcaaatcgaggctgctatcagcaatgtggatggtgtgatcgaccgccgtctgactgcgccgacggccaaccgtgccgccgatacggttaaccgcatcgagtggtttaaagcgggcgcgattaatgtaacggagatgccgtcatga

SEQ ID NO: 41271 - protein, 351 aa, Neisseria meningitidis
VFETPTFEQIRERILRDTKSLWPDADISPDSDHYVHASRLASCAEGQYAHQSWIVRQIFPDTADREYLERHASMRGLSRRNPTTASGTLTVSGIAQSMLSDDLQVRIGQRFYRTTARAVIGSGGTAEIPAIADEPGAAANVGDGEAQLMAAPAGVATECRLTVQGGTDRESDASLLARLLEIIRRPPAGGNRYDYKNWALSVDGVTSAYVYPLRRGLGTVDIAITSADGVSSEETVRRVQAYIDEMRPVTAKNALVLKPTVTAVPVTVQVKLDGIDLDEAKRRIRTALKEYFDTLIPGDGLTVSQIEAAISNVDGVIDRRLTAPTANRAADTVNRIEWFKAGAINVTEMPS

SEQ ID NO: 41272 - DNA, 1056 bp, Neisseria meningitidis
gtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgcgccgccgcaatcctaccacggccagcggcacgctgaccgtaagcggtattgcgcaatccatgctttcagacggcctgcaagtgcgtatcggccagcgtttttaccgcactaccgcccgcgccgttatcggcagcggcggcacggcggaaataccggcaatcgccgacgagccgggcgcggccgccaatgtgcgcgacggcgaggcgcaactgatggccgcccccgccggtgtgtccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgccatcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggcatcgacttggacgaggccaagcgccgcatacggacggccctaaaagaatatttcgacaccctgatccccggcgacggcctgactgtgtcgcaaatcgaggcggctatcagcaatgtggatggtgtgatcgacctccgtctgactgcgccgacggccaaccgtgccgccgatacggttaaccgcatcgagtggtttaaagcgggcgcgattaatgtaacggagatgccgtcatga

SEQ ID NO: 41273 - protein, 351 aa, Neisseria meningitidis
VFETPTFEQIRERILRDTKSLWPDADISPDSDHYVHASRLASCAEGQYAHQSWIVRQIFPDTADREYLERHASMRGLRRRNPTTASGTLTVSGIAQSMLSDGLQVRIGQRFYRTTARAVIGSGGTAEIPAIADEPGAAANVRDGEAQLMAAPAGVSTECRLTVQGGTDRESDASLLARLLEIIRRPPAGGNRYDYKNWALSVDGVTSAYVYPLRRGLGTVDIAITSADGVPSEETVRRVQAYIDEMRPVTAKNALVLKPTVTAVPVTVQVKLDGIDLDEAKRRIRTALKEYFDTLIPGDGLTVSQIEAAISNVDGVIDLRLTAPTANRAADTVNRIEWFKAGAINVTEMPS

SEQ ID NO: 41274 - DNA, 909 bp, Neisseria meningitidis
atgcgacccaagccccgtttcagacggtctgttatcgcttgctcaatatcagtgatcacgcccgaacaccttatttttaccgtttacaaacacaataccgtcttcgcccgcggccacttcttcgccgctatcatccacgcccagctgcacttcgcctttggccatagcacgcagcaggtcgagcacgtcgattttgtagcggttgcggatttcgtcggtaatcaacacgccctgagccgccgtcagacggtagcgggcaatgtcgcagcaaaggcgcaccaagatgggcggcagatcctcaaaaggtcgtctgaaccgccccagatacgcgtcgatttcggcagtggcgtccaccagcgcggtttgtgcgacctcgcggtcaatcagcccctcgttgttgcggtcggtgagctgcaagacttccagctcaccgaaacgcgcaaccatatcctcaaccgtcgcgtatgccattactcgaccgccttgcgttgcagcataggctcggcgcagattgccttccacaccgcttcgccgacttcggcgcgcttcacttcgcgccagccgccgtcaaacagcaggccgccgcgccaaaattctttgccgtctgcgccggtactgacgagcatcacatcgcggctgtccgccaaagcgtcggcggcacgttgcgtatgctgcactttgagttcggcaagttcggcggacagtgcctttttgtcgtcttcggctttttccaaggctgtggtcagcatttcgacatcgtttcgggcggcggcaagctctgcctgcacggcgtccaattcggctttgatgtcttcaaacgacggggcggcggtttcggcggtttctggtttgttgttggtttttgccatgatgactccttgtttcagacggcggcggattcgcatttga

SEQ ID NO: 41275 - protein, 302 aa, Neisseria meningitidis
MRPKPRFRRSVIACSISVITPEHLIFTVYKHNTVFARGHFFAAIIHAQLHFAFGHSTQQVEHVDFVAVADFVGNQHALSRRQTVAGNVAAKAHQDGRQILKRSSEPPQIRVDFGSGVHQRGLCDLAVNQPLVVAVGELQDFQLTETRNHILNRRVCHYSTALRCSIGSAQIAFHTASPTSARFTSRQPPSNSRPPRQNSLPSAPVLTSITSRLSAKASAARCVCCTLSSASSADSAFLSSSAFSKAVVSISTSFRAAASSACTASNSALMSSNDGAAVSAVSGLLLVFAMMTPCFRRRRIRI

SEQ ID NO: 41276 - DNA, 669 bp, Neisseria meningitidis
atgagtttgagtaaattggcgaaaaaaacggcacaaactgctaaaaatatcggcgaaaccctgcgcgcggcctttcggggaaaaatcacgctggtggtgtcgtccgagccgatacagcgcgtgcagttgagcggcttggccgacgaaaccctgcaagaccttgaacatttgcaggaatacggctttgccagccatccgcccgacggcagcgaagcggtagtgataccgctgggcggcaatacttcgcacggtgtgattgtgtgcagccagcacggcagctaccgcatcaaaaaccttaagcccggcgagacggcgatttttaatcatgagggtgcaaaaatcgtgattaagcaaggcaaaatcattgaggccgattgcgacgtgtaccgggttaactgcaaacaatacgaggttaatgcggccacggatgccaaatttaacgctccgttggtggagaccagtgcagtgttgacggcgcaaggccaaatcaacggcaacggcggcatggccgtcgagggcggcgacggagccacctttagcggcgatgttaaccaaacgggcggcagctttaacaccgacggcgacgtggtggccggcaatatatcgttgcgccagcacccgcataccgacagcatcggcggcaaaaccttaccggcggaaccggcatag

SEQ ID NO: 41277 - protein, 222 aa, Neisseria meningitidis
MSLSKLAKKTAQTAKNIGETLRAAFRGKITLVVSSEPIQRVQLSGLADETLQDLEHLQEYGFASHPPDGSEAVVIPLGGNTSHGVIVCSQHGSYRIKNLKPGETAIFNHEGAKIVIKQGKIIEADCDVYRVNCKQYEVNAATDAKFNAPLVETSAVLTAQGQINGNGGMAVEGGDGATFSGDVNQTGGSFNTDGDVVAGNISLRQHPHTDSIGGKTLPAEPA

SEQ ID NO: 41278 - DNA, 669 bp, Neisseria meningitidis; identical to SEQ ID NO: 41276

SEQ ID NO: 41279 - protein, 222 aa, Neisseria meningitidis; identical to SEQ ID NO: 41277

SEQ ID NO: 41280 - DNA, 594 bp, Neisseria meningitidis
atggtgcgcacggttaaaagctacaacggcgaggccgacgatttggcggggcaaatccatacgctgcctgcggtttgggtaacgtatggcggcagcaaagttgagcctgccagcaccggcggcgtatgcggacgttatcaggataccgccgaatttgtggtgatggtggcggcccgcaatctgcgcaacgagcaggcgcagcggcaaggcggcatcgacagccgcgaaatcggcagcaacgatttaatccgcgctgttcgccgcctgcttgacggccagcggctcggttttgccgatagccgcggcttggtgcccaaagcggtgcgcgcgattgccaatcatgtgctggtgcaaaacgccgcagtaagcatatatgcggttgagtatgccatccgctttaacacctgcgggttggaaaatgaccgctaccccgaacgcaccgacaatcccgacgaccccaaccatatctttaccaagtatcagggtacattgagcgagccgtggcctgatttcgaggggttggacggcaaaatttacgacccgcaatccgccgatgaaatacctgtaaacctaacccttaaggataagcaatga

SEQ ID NO: 41281 - protein, 197 aa, Neisseria meningitidis
MVRTVKSYNGEADDLAGQIHTLPAVWVTYGGSKVEPASTGGVCGRYQDTAEFVVMVAARNLRNEQAQRQGGIDSREIGSNDLIRAVRRLLDGQRLGFADSRGLVPKAVRAIANHVLVQNAAVSIYAVEYAIRFNTCGLENDRYPERTDNPDDPNHIFTKYQGTLSEPWPDFEGLDGKIYDPQSADEIPVNLTLKDKQ

SEQ ID NO: 41282 - DNA, 606 bp, Neisseria meningitidis; identical to SEQ ID NO: 38805

SEQ ID NO: 41283 - protein, 201 aa, Neisseria meningitidis; identical to SEQ ID NO: 38806

SEQ ID NO: 41284 - DNA, 606 bp, Neisseria meningitidis
atgaccatctatttcaaaaacggcttttacgacgacaccttgggcagcatccccgaaggcgcggttgccgtccgcgccgaagaatacgccgcccttttggcaggacaggcgcagggcgggcagattgccgcagattccgacggccgccccgttttaaccccgccgcgcccgtccgaataccacgaatgggacggcaagaaatgggaaatcggcgaagccgctgccgccgcccgtttcgccgaacaaaaaaccgccacggcattccgcctcgcggcaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttgtcgaaaaatccgcccgcctggccgttgccgccggcgcgattatcggaaagcggcagcagctcgaagacaaattgaacaccatcgaaaccgcgccaggattggacgcgctggaaaaggaaatcgaagaatggacgctaaacatcggctga

SEQ ID NO: 41285 - protein, 201 aa, Neisseria meningitidis
MTIYFKNGFYDDTLGSIPEGAVAVRAEEYAALLAGQAQGGQIAADSDGRPVLTPPRPSEYHEWDGKKWEIGEAAAAARFAEQKTATAFRLAAKADELKNSLLAGYPQVEIDSFYRQEKEALARQADNNAPTPMLAQIAAARGVELDVLIEKVVEKSARLAVAAGAIIGKRQQLEDKLNTIETAPGLDALEKEIEEWTLNIG

SEQ ID NO: 41286 - DNA, 405 bp, Neisseria meningitidis
atgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaagagacctttgcaaaattcctttccctcccgacagccgaaacccaaacacaggttttcggctgttttcgccccaaataccgcctaattttacccaaatacccccttaa

SEQ ID NO: 41287 - protein, 134 aa, Neisseria meningitidis
MNLVKLLANNWQPIAIIALVGTGLAVSHHQGYKSAFAKQQAVIDKMERDKAQALLLSAQNYARELELARAEAKKYEVKAHAVGMALAKKQAEVSRLKTERDLCKIPFPPDSRNPNTGFRLFSPQIPPNFTQIPP

SEQ ID NO: 41288 - DNA, 420 bp, Neisseria meningitidis
atgaatctcgtgaaactgctggcgaataactggcaaccgattgccatcatcgcgcttgtcggcacgggtttggcggtgtcgcaccatcaaggctacaagtcggcttttgcgaagcagcaggcggtcattgagaaaatgaagcgcgacaaggcgcaagccctgctgttgtcggctcaaaactacgcccgcgaactggaacaggcgcgtgcggaagctaaaaaatatgaagtcaaggcgcacgccgtcggcatggctttggcgaaaaaacaggcggaagtcagccgtctgaaaacggaaaataaaaaggaaatcgaaaatgtccttactcaagaccgtaaaaatgcaggcggcggttgtattgacggctttggccatcacggcttgcagctctacaagcgcgccctcggctacggaaattaa

SEQ ID NO: 41289 - protein, 139 aa, Neisseria meningitidis
MNLVKLLANNWQPIAIIALVGTGLAVSHHQGYKSAFAKQQAVIEKMKRDKAQALLLSAQNYARELEQARAEAKKYEVKAHAVGMALAKKQAEVSRLKTENKKEIENVLTQDRKNAGGGCIDGFGHHGLQLYKRALGYGN

SEQ ID NO: 41290 - DNA, 1134 bp, Neisseria gonorrhoeae
atgtttaaaaaattcaaaccggtactgttgtcattttttgcacttgtatttgccttttggctgggaacaggtattgcctatgagattaatccgcgttggtttttgagcgatacggcaactgaagtacctgaaaatccgaatgcttttgtggcgaaacttgcccgcctgttccgaaatgccgacagggcggttgtcatcgtgaaggaatcgatgaggacggaggaaagccttgccggagctgtggatgacggtccgttgcagtcggagaaggattatctcgcgctcgctatccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggctcacggggaaaattatgaaacgacaggagaatatcgggttgtttggcaaccggacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcgaagagagcaaccggattgcatcggactcgcgcgattatgtgttttatcagaatatgcgggaattgatgccccgggggatgaaggcgaacagtcttgtggtcggctatgatgcggacggtctgccgcaaaaagtctattggagtttcgacaatggaaaaaaacgccagagtttcgaatattatttgaaaaacggaaatctttttattgcacaatcttcgacggtagcattgaaagcggatggcgtaacggcggatatgcagacctatcatgcgcaacagacgtggtatttggatggcgggcggattatccgcgaagagaaacagggagacagactgcctgattttcctttgaacttggaagatttggaaaaagaggtgagccgttatgcagaggctgcggcgagacgttcgggcggcaggcgcggcctttctcactga

SEQ ID NO: 41291 - protein, 377 aa, Neisseria gonorrhoeae
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSFDNGKKRQSFEYYLKNGNLFIAQSSTVALKADGVTADMQTYHAQQTWYLDGGRIIREEKQGDRLPDFPLNLEDLEKEVSRYAEAAARRSGGRRGLSH

SEQ ID NO: 41292 - DNA, 1134 bp, Neisseria meningitidis
atgtttaaaaaattcaaaccggtactgttgtcattttttgcacttgtatttgccttttggctgggaacgggtattgcctatgagattaatccgcgttggtttttgagcgatacggcaactgaagtacctaaaaatccgaatgcttttgtggcgaaacttgcccgcctgttccgaaatgccgacagggcggttgtcatcgtgaaggaatcgataaggacggaggaaaatcttgccggaactgtggatgacggtccgttgcagtcggagaaggattatctcgcgctcgctatccggctcagtcgtttgaaagaaaaggcgaaatggtttcacgtaacggagcaggaacatgggaaagaggtttggctggattaccatatcggcgagggcggtttggttgcggtttcgctttcgcaacgctcgccggaagcatttgttaatgccgaatatctgtatcggaacgatcgtccgttttctgtaaatgtgtacggcggaacggttcacggggaaaattatgaaacgacaggagaatatcgggttgtttggcaaccagacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcaaagagagcaaccgaattgcgtcggactcgcgcaattctgtgttttatcagaatatgcgggaattgatgccccgagggatgaaggcgaacagtcttgtggtcggctatgatgcggacggtctgccgcaaaaagtctattggagtttcgacaatggaaaaaaacgccagagtttcgaatattatttgaaaaacggaaatctttttattgcacaatcttcgacggtagcattgaaagcggatggcgtaacggcggatatgcagacctatcatgcgcaacagacgtggtatttggatggcgggcggattgtccgcgaagagaaacagggagacagactgcctgattttcctttgaacttggaaaatttggaaaaagaggtgcgccgttatgcagaggctgcggcgagacgttcgggcggcaggcgcgacctttctcactga

SEQ ID NO: 41293 - protein, 377 aa, Neisseria meningitidis
MFKKFKPVLLSFFALVFAFWLGTGIAYEINPRWFLSDTATEVPKNPNAFVAKLARLFRNADRAVVIVKESIRTEENLAGTVDDGPLQSEKDYLALAIRLSRLKEKAKWFHVTEQEHGKEVWLDYHIGEGGLVAVSLSQRSPEAFVNAEYLYRNDRPFSVNVYGGTVHGENYETTGEYRVVWQPDGSVFDAAGRGKIGEDVYEHCLGCYQMAQVYLAKYRDVANDEQKVWDFRKESNRIASDSRNSVFYQNMRELMPRGMKANSLVVGYDADGLPQKVYWSFDNGKKRQSFEYYLKNGNLFIAQSSTVALKADGVTADMQTYHAQQTWYLDGGRIVREEKQGDRLPDFPLNLENLEKEVRRYAEAAARRSGGRRDLSH

SEQ ID NO: 41294 - DNA, 1125 bp, Neisseria meningitidis
atgtttaaaaaattcaaaccggtactgttgtcattttttgcacttgtatttgccttttggctgggaacgggtattgcctatgagattaatccgcgttggtttttgagcgatacggcaactgaaaatccgaatgcttttgtggcgaaacttgcccgcctgttccgaaatgccgacagggcggttgtcatcgtgaaggaatcgatgaggacggaggaaagtcttgccggagctgtggatgacggtccgttgcagtcggagaaggattatcttgcactcgctgtccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggttcacggggaaaattatgaaacgacaggagaatatcgggttgtttggcaaccggacggttcggtatttgatgcgtcggggcgcgggaaaatcggggaagatgtttatgagcattgcctcgggtgttatcagatggcccaggtatatttggcgaaatatcgggatgtcgcgaatgatgagcagaaggtttgggacttccgcgaagagagtaaccggattgcgtcggactcgcgcgattctgtgttttatcagaatatgcgggaattgatgccccgagggatgaaggcaaacagtcttgtggtcggctatgatgcggacggtctgccgcagaaagtctattggagtttcgacaatgggaaaaaacgccagagtttcgaatattatttgaaaaacggaaatctttttattgcacaatcttcgacggtagcattgaaagcggatggcgtaacggcggatatgcagacctatcatgcgcaacagacgtggtatttagatggcgggcggattgtccgcgaagagaaacagggggacagactgcctgattttcctttgaacttggaagatttggaaaaagaggtgagccgttatgcagaggctgcggcgagacgttcgggcggcaggcgcgacctttctcactga

SEQ ID NO: 41295 - protein, 374 aa, Neisseria meningitidis
MFKKFKPVLLSFFALVFAFWLGTGIAYEINPRWFLSDTATENPNAFVAKLARLFRNADRAVVIVKESMRTEESLAGAVDDGPLQSEKDYLALAVRLSRLKEKAKWFHVTEQEHGEEVWLDYYIGEGGLVAVSLSQRSPEAFVNAEYLYRNDRPFSVNVYGGTVHGENYETTGEYRVVWQPDGSVFDASGRGKIGEDVYEHCLGCYQMAQVYLAKYRDVANDEQKVWDFREESNRIASDSRDSVFYQNMRELMPRGMKANSLVVGYDADGLPQKVYWSFDNGKKRQSFEYYLKNGNLFIAQSSTVALKADGVTADMQTYHAQQTWYLDGGRIVREEKQGDRLPDFPLNLEDLEKEVSRYAEAAARRSGGRRDLSH

SEQ ID NO: 41296 - DNA, 1404 bp, Neisseria gonorrhoeae
atgaatactacattgaaaactaccttgacctctgttgcagcagcctttgcattgtctgcctgcaccatgattcctcaatacgagcagcccaaagtcgaagttgcggaaaccttccaaaacgacacatcggtttcttccatccgcgcggttgatttgggttggcatgactattttgccgacccgcgcctgcaaaagctgatcgacatcgcactcgagcgcaataccagtttgcgtacagccgtattgaacagcgaaatctaccgcaaacaatacatgatcgagcgcaacaacctcctgcccacgcttgccgccaatgcgaacggctcgcgccaaggcagcttgagcggcggcaatgtcagcagcagctacaatgtcggactgggtgcggcatcttacgaactcgatctgttcgggcgcgtgcgcagcaacagcgaagcagcactgcagggctattttgccagcgttgccaaccgcgatgcggcacatttgattctgattgccaccgttgccaaagcctatttcaacgagcgttatgccgaaaaagcgatgtctttggcgcagcgtgtcttgaaaacgcgcgaggaaacctacaagctgtccgaattgcggtacaaggcaggcgtgatttccgccgtcgccctgcgccagcaggaagccttgattgaatctgccaaagccgattatgcccatgccgcgcgcagccgcgaacaggcgcgcaatgccttggcaaccttgattaaccgtccgatacccgaagacctgcccgccggtttgccgttggacaagcagttttttgttgaaaaactgcctgccggtttgagttccgaagtattgctcgaccgtcccgacatccgcgccgccgaacacgcgctcaaacaggcaaacgccaatatcggtgcggcgcgcgccgcctttttcccgtccatccgcctgaccggaagcgtcggtacgggttctgtcgaattgggcgggctgttcaaaagcggcacgggcgtttgggcgttcgctccgtctattaccctgccgatttttacttggggaacgaacaaggcgaaccttgatgtggcaaaactgcgccaacaggcacaaattgttgcctatgaatccgccgtccaatccgcctttcaagacgtggcaaacgcattggcggcgcgcgagcagctggataaagcctatgacgctttaagcaaacaaagccgcgcctctaaagaagcgttgcgcttggtcggactgcgttacaaacacggcgtatccggcgcgctcgatttgctcgatgcggaacgcatcagctattcggcggaaggtgcggctttgtcggcacaactgacccgcgccgaaaaccttgccgatttgtacaaggcgctcgacggcggattgaaacgggatacccaaaccggcaaataa

SEQ ID NO: 41297 - protein, 467 aa, Neisseria gonorrhoeae
MNTTLKTTLTSVAAAFALSACTMIPQYEQPKVEVAETFQNDTSVSSIRAVDLGWHDYFADPRLQKLIDIALERNTSLRTAVLNSEIYRKQYMIERNNLLPTLAANANGSRQGSLSGGNVSSSYNVGLGAASYELDLFGRVRSNSEAALQGYFASVANRDAAHLILIATVAKAYFNERYAEKAMSLAQRVLKTREETYKLSELRYKAGVISAVALRQQEALIESAKADYAHAARSREQARNALATLINRPIPEDLPAGLPLDKQFFVEKLPAGLSSEVLLDRPDIRAAEHALKQANANIGAARAAFFPSIRLTGSVGTGSVELGGLFKSGTGVWAFAPSITLPIFTWGTNKANLDVAKLRQQAQIVAYESAVQSAFQDVANALAAREQLDKAYDALSKQSRASKEALRLVGLRYKHGVSGALDLLDAERISYSAEGAALSAQLTRAENLADLYKALDGGLKRDTQTGK

SEQ ID NO: 41298 - DNA, 1404 bp, Neisseria meningitidis
atggatactacattgaaaaccaccttgacttctgttgcagcagcctttgcattgtctgcctgcaccatgattccccaatacgagcagcccaaagtcgaagttgccgaaacgttcaaaaacgataccgccgacagcggcatccgcgccgtcgatttaggttggcatgactattttgccgacccgcgcctgcaaaagctgatcgacatcgcactcgagcgcaataccagtttgcgtaccgccgtattgaacagcgaaatctaccgcaaacaatacatgattgagcgcaacaacctcctgcccacgcttgccgccaatgcgaacgactcgcgccaaggcagcttgagcggcggcaatgtaagcagcagctacaaagtcggactgggtgcggcatcttacgaactcgatctgttcgggcgtgtacgcagcagcagcgaggcggcactgcaaggctatttcgccagcaccgccaaccgcgatgcggcacatttgagcctgattgccaccgttgccaaagcctatttcaacgaacgttacgccgaagaagcgatgtctttggcgcaacgtgttttgaaaacgcgcgaggaaacctacaagctgtccgaattacgttacaaggcaggcgtgatttccgccgtcgccctacgtcagcaggaagccctgatcgaatctgccaaagccgattatgcccatgccgcgcgcagccgcgaacaggcgcgcaatgccttggcaaccttgattaaccaaccgatacccgaagacctgcctgccggtttgccgctggacaagcagttttttgttgaaaaactgccggccggtttgagttccgaagtattgctcgaccgtcccgatatccgtgctgccgaacacgcgctcaaacaggcaaacgccaatatcggtgcggcacgcgccgcctttttcccatccatccgcctgaccggaaccgtcggtacgggttctgccgaattgggtgggttgttcaaaagcggcacgggcgtttggtcgttcgcgccgtctattaccctgccgatttttacctggggtacgaacaaggcgaaccttgatgtagccaagctgcgccaacaggtacaaatcgttgcctatgaatccgccgtccaatccgcatttcaagacgtggcaaacgcattggcggcgcgcgagcagctggataaagcctatgacgctttaagcaaacaaagccgcgcctctaaagaagcgttgcgcttggtcggcctgcgttacaagcacggcgtatccggcgcgctcgacttgctcgatgcggaacgcagcagctatgcggcggagggtgcggctttgtcggcacaactgacccgcgccgaaaaccttgccgatttgtacaaggcactcggcggcggattgaaacgggatacccaaaccgacaaataa

SEQ ID NO: 41299 - protein, 467 aa, Neisseria meningitidis
MDTTLKTTLTSVAAAFALSACTMIPQYEQPKVEVAETFKNDTADSGIRAVDLGWHDYFADPRLQKLIDIALERNTSLRTAVLNSEIYRKQYMIERNNLLPTLAANANDSRQGSLSGGNVSSSYKVGLGAASYELDLFGRVRSSSEAALQGYFASTANRDAAHLSLIATVAKAYFNERYAEEAMSLAQRVLKTREETYKLSELRYKAGVISAVALRQQEALIESAKADYAHAARSREQARNALATLINQPIPEDLPAGLPLDKQFFVEKLPAGLSSEVLLDRPDIRAAEHALKQANANIGAARAAFFPSIRLTGTVGTGSAELGGLFKSGTGVWSFAPSITLPIFTWGTNKANLDVAKLRQQVQIVAYESAVQSAFQDVANALAAREQLDKAYDALSKQSRASKEALRLVGLRYKHGVSGALDLLDAERSSYAAEGAALSAQLTRAENLADLYKALGGGLKRDTQTDK

SEQ ID NO: 41300 - DNA, 1404 bp, Neisseria meningitidis
atggatactacattgaaaaccaccttgacttctgttgcagcagccttcgcattatccgcctgcaccatgattccccaatacgagcagcccaaagtcgaagttgccgaaacgttcaaaaacgataccgccgacagcggcatccgtgcggtcgatttgggttggcatgactattttgccgacccgcgcctgcaaaagctgatcgacatcgcactcgagcgcaataccagtttgcgtaccgccgtattgaacagcgaaatctaccgcaaacaatacatgattgagcgcaacaacctcctgcccacgcttgccgccaatgcgaacgactcgcgccaaggcagcttgagcggcggcaatgtaagcagcagctacaaagtcggactgggtgcggcatcttacgaactcgatctgttcgggcgtgtacgcagcagcagcgaggcggcactgcaaggctatttcgccagcaccgccaaccgcgatgcggcacatttgagcctgattgccaccgttgccaaagcctatttcaacgaacgttatgccgaagaagcgatgtctttggcgcaacgtgttttgaaaacgcgcgaggaaacctacaagctgtccgaattacgttacaaggcaggcgtgatttccgccgtcgccctacgtcagcaggaagccctaatcgaatctgccaaagccgattatgcccatgccgcgcgcagccgcgaacaggcgcgcaatgccttggcaaccctgattaaccaaccgatacccgacgacctgcccgccggtttgccgttggacaagcagttttttgttgagaagctgccggccggtttgagttccgaagtattgctcgaccgtcccgatatccgtgctgccgaacacgcgctcaaacaggcaaacgccaatatcggtgcggcacgcgccgcctttttcccatccatccgcctgaccggaagcgtcgatacgcattctgccgaattgggcgggctgttcaaaagcggcaccggcgtttggttgttcgcaccttccattaccctgccgatttttacctggggtacgaacaaggcgaacctcgatgtagccaagctgcgccaacaggcacaaatcgttgcctatgaagccgccgtccaatccgcatttcaagacgtggcaaacgcattgaccgcgcgcgagcagttggataaagcctatgacgctttaagcaaacaaagccgcgcctctaaagaagcgttgcgtttggtcggtctgcgttacaaacacggcgtatccggcgcgctcgacttgctcgatgcggaacgcagcagctattcggcggaaggtgcggctttgtcggcacaactgacccgcgccgaaaaccttgccgatttgtacaaggcactcggcggcggattgaaacgggatacccaaaccgacaaataa

SEQ ID NO: 41301 - protein, 467 aa, Neisseria meningitidis
MDTTLKTTLTSVAAAFALSACTMIPQYEQPKVEVAETFKNDTADSGIRAVDLGWHDYFADPRLQKLIDIALERNTSLRTAVLNSEIYRKQYMIERNNLLPTLAANANDSRQGSLSGGNVSSSYKVGLGAASYELDLFGRVRSSSEAALQGYFASTANRDAAHLSLIATVAKAYFNERYAEEAMSLAQRVLKTREETYKLSELRYKAGVISAVALRQQEALIESAKADYAHAARSREQARNALATLINQPIPDDLPAGLPLDKQFFVEKLPAGLSSEVLLDRPDIRAAEHALKQANANIGAARAAFFPSIRLTGSVDTHSAELGGLFKSGTGVWLFAPSITLPIFTWGTNKANLDVAKLRQQAQIVAYEAAVQSAFQDVANALTAREQLDKAYDALSKQSRASKEALRLVGLRYKHGVSGALDLLDAERSSYSAEGAALSAQLTRAENLADLYKALGGGLKRDTQTDK

SEQ ID NO: 41302 - DNA, 1731 bp, Neisseria gonorrhoeae
gtgaaaccgctgcgcagactgacaaacctccttgccgcctgcgccgtagcggcggtcgcactcatacagcccgccctcgcggcggacttggcgcaagacccgttcattaccgataacacccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcggcaatccaaggcaatcttggttacaccgtccgcttttccggacacggacacgaagaacacgcccccttcgacaaccacgccgccgacagcgcaagcgaagaaaaaggcaacgttgacgacggctttaccgtgtaccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatattcgacaactacaacaacctcggcagcaatttctccgaccgcgccgatgaagccaacagaaaaatgttcgagcacaatgccaagctcgaccgctggggcaacagcatggagtttgtcaacggcgtcgccgccggcgcgctcaacccctttatcagcgcgggcgaagccttgggcataggcgacatactgtacggaacgcgctatgccatagacaaagccgcgatgcgcaacatcgcccccttacccgccgagggcaaattcgccgccatcggcggcttgggcagcgcggcgggctttgaaaaaaatacgcgcgaagccgttgaccggtggatacaggaaaaccccaatgccgccgaaaccgtcgaagccctggtcaacgtcctgccgtttgccaaagtcaaaaacctgacaaaggcggcaaaaccggggaaggctgcggttagtggggatttttctaaatcctacacctgctccttccacggcagcaccttggtcaaaacggcagacggctacaaagccattgcccatattcaagccggagaccgcgtcctttccaaggacgaggcaagcggagaaacgggatacaaacccgttaccgcccgatacggcaatccgtatcaagaaaccgtttacattgaagtttcagacggcatcggcaacagccaaaccctgatttccaaccgcatccacccgttttattcggacggcaaatggattaaggcggaagatttaaaagcgggaagccggctgttatccgaaagcggcaaaacccaaaccgtccgcaacatcgttgtcaaaccaaaaccgctcaaagcctacaatctgaccgttgccgattggcatacctacttcgtcaagggtaatcaggcggaaacggaaggggtttgggttcataatgattgtccgcctaaaccaaaaccaaccaatcatgcccaacaaagaaaagaagaagctaaaaacgattctcatcgaagtgtgggagattccaatcgtgtcgttcgcgaaggaaagcaatatttagattccgacacaggaaaccatgtttatgtaaaaggagataaagtggttattctaactcctgatggaagacaggtaactcaatttaagaactcgaaagccaatacgtcaaaaagggtaaaaaatgggaaatggacaccaaaataa

SEQ ID NO: 41303 - protein, 576 aa, Neisseria gonorrhoeae
VKPLRRLTNLLAACAVAAVALIQPALAADLAQDPFITDNTQRQHYEPGGKYHLFGDPRGSVSDRTGKINVIQDYTHQMGNLLIQQAAIQGNLGYTVRFSGHGHEEHAPFDNHAADSASEEKGNVDDGFTVYRLNWEGHEHHPADAYDGPKGGNYPKPTGARDEYTYHVNGTARSIKLNPTDTRSIRQRIFDNYNNLGSNFSDRADEANRKMFEHNAKLDRWGNSMEFVNGVAAGALNPFISAGEALGIGDILYGTRYAIDKAAMRNIAPLPAEGKFAAIGGLGSAAGFEKNTREAVDRWIQENPNAAETVEALVNVLPFAKVKNLTKAAKPGKAAVSGDFSKSYTCSFHGSTLVKTADGYKAIAHIQAGDRVLSKDEASGETGYKPVTARYGNPYQETVYIEVSDGIGNSQTLISNRIHPFYSDGKWIKAEDLKAGSRLLSESGKTQTVRNIVVKPKPLKAYNLTVADWHTYFVKGNQAETEGVWVHNDCPPKPKPTNHAQQRKEEAKNDSHRSVGDSNRVVREGKQYLDSDTGNHVYVKGDKVVILTPDGRQVTQFKNSKANTSKRVKNGKWTPK

SEQ ID NO: 41304 - DNA, 1404 bp, Neisseria meningitidis
gtgaaaccgctgcgcagactgacaaacctccttgccgcctgcgccgtagcggcggccgcactcatacagcccgccctcgcggcggacttggcgcaagacccgttcattaccgataacgcccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcaaacatcaacggcacaatcggctaccacacccgcttttccggacacggacacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccttgggcataggcgacatactgtacggaacgcgctatgccatagacaaagccgcaatgcgcaacatcgcccccttgcccgccgagggcaaattcgccgtcatcggcggcttgggcagcgtggcgggctttgaaaagaatacgcgcgaagccgttgaccggtggatacaggaaaatcccaatgccgccgaaaccgtcgaagccgtcttcaacgttgccgcagcagccaaagtcgcgaagttggcaaaggcggcaaaaccagggaaggctgcggttagcggggattttgctgattcttataaaaagaaattggctttgtctgatagtgcgagacagttatatcaaaatgcaaagtatagagaagctctagatatacattatgaagatttaattagaagaaaaactgatggttcatcaaaatttattaacggcagagaaattgacgctgttacgaatgatgctttaatacaagccaaaagaacaatttcagcaatagataaacctaaaaatttcttaaatcaaaaaaatagaaagcaaattaaagcaaccatcgaagcagcaaaccaacagggaaaacgtgcagaattttggtttaaatacggtgttcattcacaagttaagtcatatattgaatcaaaaggcggcattgttaaaacaggtttaggagattaa

SEQ ID NO: 41305 - protein, 467 aa, Neisseria meningitidis
VKPLRRLTNLLAACAVAAAALIQPALAADLAQDPFITDNAQRQHYEPGGKYHLFGDPRGSVSDRTGKINVIQDYTHQMGNLLIQQANINGTIGYHTRFSGHGHEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEALGIGDILYGTRYAIDKAAMRNIAPLPAEGKFAVIGGLGSVAGFEKNTREAVDRWIQENPNAAETVEAVFNVAAAAKVAKLAKAAKPGKAAVSGDFADSYKKKLALSDSARQLYQNAKYREALDIHYEDLIRRKTDGSSKFINGREIDAVTNDALIQAKRTISAIDKPKNFLNQKNRKQIKATIEAANQQGKRAEFWFKYGVHSQVKSYIESKGGIVKTGLGD

SEQ ID NO: 41306 - DNA, 1497 bp, Neisseria meningitidis
gtgaaaccgctgcgaagactcatcaagctccttgccgcctgtgccgtagcggcggccgcactcatacagcccgccctcgcggcggacttggcgcaagacccgttcattaccgataacgcccaacggcagcactacgaacccggaggcaaataccacctcttcggcgacccgcgcggcagcgtctccgaccgcaccggtcaaatcaacgtcatccaagactatacccaccggatgggcaacctgctcatccagcaggcaaacatcaacggcacaatcggctaccacacccgcttttccggacacggatacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggtgcacgcgacgaatacacctatcacgtcaacggcacagcacgcagcatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccttgggcataggcgacatactgtacggaacgcgctatgccatagacaaagccgcaatgcgcaacatcgcccccttgcccgccgagggcaaattcgccgtcatcggcggcttgggcagcgtggcgggctttgaaaaaaatacgcgcgaagccgttgaccggtggatacaggaaaaccccaatgccgccgaaaccgtcgaagccctggtcaacgtcctgccgtttgccaaagtcaaaaacctgacaaaggcggcaaaaccggggaaggctgcggttagcggggatttttctgctgcatacaatacaagaacaactagaaaagttactacagaaacagaggggttaaatagaatcagacagaaccagaaaaatagtaatatacatgagaaaaattatggaagagataatcctaatcatattaatgttttatctggaaattctatacaacatatactgtatggagatgaagcaggaggtgggcatctttttcctggcaaacctggtaagacaacattcccccaacattggtcagccagtaaaataactcatgaaattagtgatatcgttacatccccaaaaacgcaatggtatgcacagactggaacaggcggcaaatatattgctaaaggaagaccagctaggtgggtatcatatgaaacgagagatggaattcgtatcagaacagtttatgaacctgcaacaggaaaagtggtaactgcattccccgatagaacctctaatcccaaatataaccctgtaaaataa

SEQ ID NO: 41307 - protein, 498 aa, Neisseria meningitidis
VKPLRRLIKLLAACAVAAAALIQPALAADLAQDPFITDNAQRQHYEPGGKYHLFGDPRGSVSDRTGQINVIQDYTHRMGNLLIQQANINGTIGYHTRFSGHGYEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEALGIGDILYGTRYAIDKAAMRNIAPLPAEGKFAVIGGLGSVAGFEKNTREAVDRWIQENPNAAETVEALVNVLPFAKVKNLTKAAKPGKAAVSGDFSAAYNTRTTRKVTTETEGLNRIRQNQKNSNIHEKNYGRDNPNHINVLSGNSIQHILYGDEAGGGHLFPGKPGKTTFPQHWSASKITHEISDIVTSPKTQWYAQTGTGGKYIAKGRPARWVSYETRDGIRIRTVYEPATGKVVTAFPDRTSNPKYNPVK

SEQ ID NO: 41308 - DNA, 255 bp, Neisseria gonorrhoeae
gattttcgagcgttttcatgcgagaacggtttgtctgtgcgcgtccgcaatttggacggcggcaaaatcgcgttgcggctggacggcaggcgtgccgtcctctcttccgacgttgccgcatccggcgaacgctataccgccgaacacggtttgttcggaaacggaaccgagtggcaccagaaaggcggcgaagcctttttcggctttaccgatgcctacggcaattcggtcgaaacttcctgccgcgcccgttaa

SEQ ID NO: 41309 - protein, 84 aa, Neisseria gonorrhoeae
DFRAFSCENGLSVRVRNLDGGKIALRLDGRRAVLSSDVAASGERYTAEHGLFGNGTEWHQKGGEAFFGFTDAYGNSVETSCRAR

SEQ ID NO: 41310 - DNA, 381 bp, Neisseria meningitidis
atgaatatcaggtttttcgcgctgaccgtaccggttttgtctttggcggcctgtgccgtgccggaggcgtatgatgacggcggacgcgggcatatgccgcccgttcaaaaccaagccggcacggacgattttcgggcgttttcctgcgagaacggtttgtctgtgcgcgtccgccatttggacagcggcaaagtcgcgttgcggctggacggcaggcgtgccgtcctctcttccgacgttgccgcatccggcgaacgctataccgccgaacacggtttgttcggaaacgcaaccgagtggcaccagaaaggcggcgaagcctttttcggctttaccgatgcctacggcaattcggtcgaaacttcctgccgcgcccgttaa

SEQ ID NO: 41311 - protein, 126 aa, Neisseria meningitidis
MNIRFFALTVPVLSLAACAVPEAYDDGGRGHMPPVQNQAGTDDFRAFSCENGLSVRVRHLDSGKVALRLDGRRAVLSSDVAASGERYTAEHGLFGNATEWHQKGGEAFFGFTDAYGNSVETSCRAR

SEQ ID NO: 41312 - DNA, 381 bp, Neisseria meningitidis
atgaatatcaggtttttcgcgctgaccgtaccggttttgtctttggcggcctgtgccgtgccggaggcgtatgatgacggcggacgagggcatatgccgcccgttcaaaaccaagccggcacggcagattttcgggcattttcctgcgagaacggtttgtctgtgcacgtccgccgtttggacggcggcagaatcgcgttgcggttggacggcaggcgtgccgtcctctcttccgacgttgccgcatccggcgaacgctataccgccgaacacggtttgttcggaaacggaaccgagtggcatcagaaaggcggcgaagcctttttcggctttaccgatgcctacggcaattcggtcgaaacctcctgccgcgcccgctaa

SEQ ID NO: 41313 - protein, 126 aa, Neisseria meningitidis
MNIRFFALTVPVLSLAACAVPEAYDDGGRGHMPPVQNQAGTADFRAFSCENGLSVHVRRLDGGRIALRLDGRRAVLSSDVAASGERYTAEHGLFGNGTEWHQKGGEAFFGFTDAYGNSVETSCRAR

SEQ ID NO: 41314 - DNA, 1476 bp, Neisseria gonorrhoeae
atgtcgaaacctgtttttaagaaaatcgcactttatactttgggtgcaatcagcggcgtggccgtaagtctggcggtgcagggttttgccgccgagaaggacgggcgggataacgaagtcctgccggtgcaatccatccgtacgatggcggaggtttacggtcagattaaggcaaactactatcatgacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggttttgtcaaagtggtttcgccgattgaggacacgcctgccgaacgggcggaggtgaaaagcggcgatttcattgtgaaaatcgataatgtttcgacgcgcggtatgacggtcagcgaagcggtgaaaaaaatgcggggcaagccgggtacgaagattactttgacgttgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgaccggcgcggtcggcgtgtcggcggcgtttctgccgtctgaagcggtcgtcgtcagcaccaagggacgcgacggcaaagacggcatggtactgaaagccgttcccgaggattatgtgtacggtatgggcggcgaccctttggcgggtattcctgccgagttgaaaacgattccgatgacggtattggtcaattccggttcggcttccgcgtcggagattgtcgccggcgcattgcaggaccacaaacgcgcggtcatcgtcggtacgcagagcttcggtaaaggttcggttcagactttgattcctttgtccaacggcagcgcggtcaagttgacgaccgccctgtattacacgccgaacgaccgttccattcaggcacaggggattgttcccgatgtcgaagtaaaagataaggaacgtacttttgaaagccgcgaggcggacctggtcggacacatcggcaatcccttgggcggcgaggatgtgaacagtgaaacccttgccgtaccgcttgaaaaagatgcggataagcccgctgcaaaagaaaaaggtaaaaagaaaaaggacgaggatttgtcttcaaggcggattccgaaccctgcgaaagacgatcagttgcgtaaggctttggatttggtcaagtcgcccgagcagtggcagaagtctttggggctggcggcgaaaaaaccggtttcaaataaagataaaaaagataagaagtag

SEQ ID NO: 41315 - protein, 491 aa, Neisseria gonorrhoeae
MSKPVFKKIALYTLGAISGVAVSLAVQGFAAEKDGRDNEVLPVQSIRTMAEVYGQIKANYYHDKPDADLFEGAMKGMVAGLDPHSEYMDKKGYAEIKESTSGEFGGLGMEIGQEDGFVKVVSPIEDTPAERAEVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDGMVLKAVPEDYVYGMGGDPLAGIPAELKTIPMTVLVNSGSASASEIVAGALQDHKRAVIVGTQSFGKGSVQTLIPLSNGSAVKLTTALYYTPNDRSIQAQGIVPDVEVKDKERTFESREADLVGHIGNPLGGEDVNSETLAVPLEKDADKPAAKEKGKKKKDEDLSSRRIPNPAKDDQLRKALDLVKSPEQWQKSLGLAAKKPVSNKDKKDKK

SEQ ID NO: 41316 - DNA, 1485 bp, Neisseria meningitidis
atgtcgaaacctgtttttaagaaaatcgcactttatactttgggtgcaatcagcggcgtggccgtcagtctggcggtgcagggttttgccgccgagaaggacaggcgggataacgaagtcctgccggtgcaatccatccgcacaatggcggaggtttacggtcaaatcaaggcaaactactatcaggacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggatttgtcaaagtggtttcgccgattgaggacacgcctgcggaacgggcgggggtgaaaagcggcgatttcattgtgaaaatcgataatgtttcgacacgcggcatgacggtcagcgaagcggtgaagaaaatgcggggcaagccgggtacgaagattactttgacgctgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgactggcgcggtcggcgtgtcggcggcatttctgccgtctgaagcagtcgtcgtcagcaccaagggacgcgacggcaaagaccgcatggtactgaaagccattcctgaagattatgtgtacgggatgggcggcgattcgttggcgggcattcctgccgagttgaaaaccataccgatgacggtattggtcaattccggttcggcttccgcgtcggagattgtcgcaggtgcattgcaggatcataaacgcgcggtcatcgtcggtacgcagagcttcggcaaaggttcggttcagactttgattcctttgtccaacggcagcgcggtcaagctgacaacggcactgtattatacgccgaacgaccgttctattcaggcgcaggggattgttcccgatgtcgaagtaaaagataaggaacgcatttttgaaagccgcgaggcggatttggtcggacacatcggcaatcccttgggcggcgaggatgtgaacggtgaaacccttgccgtgccgcttgaaaaagatgcggataagcccgctgtaaaagaaaaaggtaaaaagaaaaaggacgaggatttgtcttcaaggcggattcccaaccctgccaaagacgaccagttgcggaaagctttggatttagtcaagtcgcccgagcagtggcagaagtctttggggctggcggcgaaaaagccggtttcaaataaagataagaaagataaaaaagataagaagtag

SEQ ID NO: 41317 - protein, 494 aa, Neisseria meningitidis
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAIPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNGETLAVPLEKDADKPAVKEKGKKKKDEDLSSRRIPNPAKDDQLRKALDLVKSPEQWQKSLGLAAKKPVSNKDKKDKKDKK

SEQ ID NO: 41318 - DNA, 1485 bp, Neisseria meningitidis
atgtcgaaacctgtttttaagaaaatcgcactttatactttgggtgcaatcagcggcgtggccgtcagtctggcggtgcagggttttgccgccgagaaggacaggcgggataacgaagtcctgccggtgcaatccatccgcacaatggcggaggtttacggtcaaatcaaggcaaactactatcaggacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggatttgtcaaagtggtttcgccgattgaggacacgcctgcggaacgggcgggggtgaaaagcggcgatttcattgtgaaaatcgataatgtttcgacacgcggcatgacggtcagcgaagcggtgaagaaaatgcggggcaagccgggtacgaagattactttgacgctgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgactggcgcggtcggcgtgtcggcggcatttctgccgtctgaagcagtcgtcgtcagcaccaagggacgcgacggcaaagaccgcatggtactgaaagccgttcctgaagattatgtgtacgggatgggcggcgattcgttggcgggcattcctgccgagttgaaaaccataccgatgacggtattggtcaattccggttcggcttccgcgtcggagattgtcgcaggtgcattgcaggatcataaacgcgcggtcatcgtcggtacgcagagcttcggcaaaggttcggttcagactttgattcctttgtccaacggcagcgcggtcaagctgacaacggcactgtattatacgccgaacgaccgttctattcaggcgcaggggattgttcccgatgtcgaagtaaaagataaggaacgcatttttgaaagccgcgaggcggatttggtcggacacatcggcaatcctttgggcggcgaggatgtgaacagtgaaacccttgccgtgccgcttgaaaaagatgcggataagcccgctgtaaaagaaaaaggtaaaaagaaaaaggacgaggatttgtcttcaaggcggattcccaaccctgccaaagacgaccagttgcggaaagctttggatttagtcaagtcgcccgagcagtggcagaagtctttggggctggcggcgaaaaagccggtttcaaataaagataagaaagataaaaaagataagaagtag

SEQ ID NO: 41319 - protein, 494 aa, Neisseria meningitidis
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAVPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNSETLAVPLEKDADKPAVKEKGKKKKDEDLSSRRIPNPAKDDQLRKALDLVKSPEQWQKSLGLAAKKPVSNKDKKDKKDKK

SEQ ID NO: 41320 - DNA, 372 bp, Neisseria gonorrhoeae
atgatgaatccgaaaaccttgggccgtttgtcgctgtgtgcggcggtcttggctctgaccgcctgcgccggcggcgggcataaaaacctgtattattacggcggttatcccgataccgtctatgaaggtttgaaaaacgacgacacttcgttgggcaagcagaccgaaaagatggaaaaatactttgcggaagccgccaacaaaaaaatgaatgccgccccgggtgcgcacgcccatttgggactgctgctttcccgttcgggagacaaagagggcgcgttccgccaatttgaagaagagaaaaggctgtttcccgaatcgggcgtatttatggacttcctgatgaaaaccggtaaaggaggcaagcgatga

SEQ ID NO: 41321 - protein, 123 aa, Neisseria gonorrhoeae
MMNPKTLGRLSLCAAVLALTACAGGGHKNLYYYGGYPDTVYEGLKNDDTSLGKQTEKMEKYFAEAANKKMNAAPGAHAHLGLLLSRSGDKEGAFRQFEEEKRLFPESGVFMDFLMKTGKGGKR

SEQ ID NO: 41322 - DNA, 372 bp, Neisseria meningitidis
atgatgaatccgaaaaccttgagccgtttgtcgctgtgtgcggcggtcttggctctgaccgcctgcggcggcaacgggcaaaaatccctgtattattacggcggctatcccgataccgtctatgaaggtttgaaaaacgacgacacttcgttgggcaagcagaccgaaaagatggaaaaatactttgtggaagccggcaacaaaaaaatgaatgccgccccgggtgcgcacgcccatctgggactgctgctttcccgttcgggagacaaagagggcgcgttccgccagtttgaagaagagaaaaggctgtttcccgaatcgggcgtatttatggacttcctgatgaaaaccggtaaaggaggcaagcgatga

SEQ ID NO: 41323 - protein, 123 aa, Neisseria meningitidis
MMNPKTLSRLSLCAAVLALTACGGNGQKSLYYYGGYPDTVYEGLKNDDTSLGKQTEKMEKYFVEAGNKKMNAAPGAHAHLGLLLSRSGDKEGAFRQFEEEKRLFPESGVFMDFLMKTGKGGKR

SEQ ID NO: 41324 - DNA, 372 bp, Neisseria meningitidis; identical to SEQ ID NO: 41322

SEQ ID NO: 41325 - protein, 123 aa, Neisseria meningitidis; identical to SEQ ID NO: 41323

SEQ ID NO: 41326 - DNA, 483 bp, Neisseria gonorrhoeae
atgatgaaaaagatactggcagtatcggcactatgcctgatgactgcggcggcacaggctgccgatacttacggctatctcgccgtttggcagaatccgcaggatgcaaacgatgttttgcaggttaaaaccacaaaagaagattcggcgaaaagcgaagcgtttgccgagttggaagccttttgcaaaggtcaggacacgcttgcgggcattgccgaagacgagccgaccggatgccggtcggtcgtgtcgctgaacaatacctgtgtctcgctggcatacccgaaagccttgggcgcgatgcgcgttgaaaacgccgtcgtgattacttctccgcgttttacgagcgttcatcaggtcgcactcaaccagtgcataaaaaaatacggcgcacagggacaatgcggcttggaaacagtgtattgcacgtcatcttcttattacggcggggctgttcgctccttaatccaacacctgaaataa

SEQ ID NO: 41327 - protein, 160 aa, Neisseria gonorrhoeae
MMKKILAVSALCLMTAAAQAADTYGYLAVWQNPQDANDVLQVKTTKEDSAKSEAFAELEAFCKGQDTLAGIAEDEPTGCRSVVSLNNTCVSLAYPKALGAMRVENAVVITSPRFTSVHQVALNQCIKKYGAQGQCGLETVYCTSSSYYGGAVRSLIQHLK

SEQ ID NO: 41328 - DNA, 279 bp, Neisseria meningitidis
tcgggcattgctgaagacgagccgaccggatgccggtcggtcgtgtcgctgaacaatacctgtgtcgcgctggcatacccgaaagccttgggcgcgctgcgtgtcgacaacgccgtcgtgattacttctccgcgttttacgagcgttcatcaggtcgcactcaaccagtgcatcaaaaaatacggcgtacagggacaatgcggcttggaaacagtgtattgcacatcttcttcttattacggcggaactgtgcgctctttgattcaaaatctcaaataa

SEQ ID NO: 41329 - protein, 92 aa, Neisseria meningitidis
SGIAEDEPTGCRSVVSLNNTCVALAYPKALGALRVDNAVVITSPRFTSVHQVALNQCIKKYGVQGQCGLETVYCTSSSYYGGTVRSLIQNLK

SEQ ID NO: 41330 - DNA, 483 bp, Neisseria meningitidis
atgatgaaaaagatactggccgtatcggcactatgcctgatgactgcggcggcacgggctgccgatacttacggctatctcgccgtttggcagaatccgcagaatgcaaacgatgttttgcaggttaaaaccacaaaagaagattcgacgaaaagcgaagcgtttgccgagttggaagctttctgcaaaggtcaggacacgcttgcgggcattgccgaagacgagccgaccggatgccggtcggtcgtgtcgctgaacaatacctgtgtcgcgctggcatacccgaaagccttgggcgcgatgcgcgttgaaaacgccgttgtgattacttctccgcgttttacgagcgtttatcaggtcgcactcaaccagtgcatcaaaaaatacggcgcacagggacaatgcggcttggaaacagtgtattgcacgtcttcttcttattacgggggaactgtgcgctctttgattcaaaatctcaaataa

SEQ ID NO: 41331 - protein, 160 aa, Neisseria meningitidis
MMKKILAVSALCLMTAAARAADTYGYLAVWQNPQNANDVLQVKTTKEDSTKSEAFAELEAFCKGQDTLAGIAEDEPTGCRSVVSLNNTCVALAYPKALGAMRVENAVVITSPRFTSVYQVALNQCIKKYGAQGQCGLETVYCTSSSYYGGTVRSLIQNLK

SEQ ID NO: 41332 - DNA, 420 bp, Neisseria meningitidis
atgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaaataaaaaggaaatcgaaaatgtccttactcaagaccgtaaaaatgcaagcggcggttgcattgacggctttggctctcacggcctgcagctctacaaccgcgccctcggctacggaaattaa

SEQ ID NO: 41333 - protein, 139 aa, Neisseria meningitidis
MNLVKLLANNWQPIAIIALVGTGLAVSHHQGYKSAFAKQQAVIDKMERDKAQALLLSAQNYARELELARAEAKKYEVKAHAVGMALAKKQAEVSRLKTENKKEIENVLTQDRKNASGGCIDGFGSHGLQLYNRALGYGN

SEQ ID NO: 41334 - DNA, 420 bp, Neisseria meningitidis; identical to SEQ ID NO: 41288

SEQ ID NO: 41335 - protein, 139 aa, Neisseria meningitidis; identical to SEQ ID NO: 41289

SEQ ID NO: 41336 - DNA, 777 bp, Neisseria gonorrhoeae
atgaattttatccgttccgtcggggcgaaaaccctcggccttattcaatccttcggcagtatcacgctgtttctgctgaacattttggcgaaatccggcacggctttcgcccgtccgcgcctgagcgtgcgccaagtgtattttgccggcgtgctgtcggtgctgattgttgccgtttcggggctgttcgtcggtatggttttgggtttgcagggctatacgcagttgtcgaaattcaaatccgccgatattttgggctatatggtcgcggcttctctgttgcgcgaactgggtcccgtgttggcggcgattctgtttgccagcagcgcgggcggtgcgatgaccagcgaaatcggtttgatgaaaacgaccggacagctcgaagcgatgaacgtgatggcggtcaaccccgtcgcccgcgtggttgccccgcgtttttgggcgggcgtgttttctatgccgcttttggcttcgattttcaacgtcgcgggcattttcggcgcgtatttggtcggcgtgagctggctgggtttggacagcggtattttctggccgcagatgcagaacaacattacgatacattacgatgtaatcaacggtttgatcaaatccgccgcgttcggcgtggcggtaacgctgattgccgtgcatcagggcttccactgcatcccgacttcggaaggcattttgcgcgccagcacgcgcacggtggtttcgtccgccctgacgattttggcggtcgattttatattgaccgcgtggatgtttacagattga

SEQ ID NO: 41337 - protein, 258 aa, Neisseria gonorrhoeae
MNFIRSVGAKTLGLIQSFGSITLFLLNILAKSGTAFARPRLSVRQVYFAGVLSVLIVAVSGLFVGMVLGLQGYTQLSKFKSADILGYMVAASLLRELGPVLAAILFASSAGGAMTSEIGLMKTTGQLEAMNVMAVNPVARVVAPRFWAGVFSMPLLASIFNVAGIFGAYLVGVSWLGLDSGIFWPQMQNNITIHYDVINGLIKSAAFGVAVTLIAVHQGFHCIPTSEGILRASTRTVVSSALTILAVDFILTAWMFTD

SEQ ID NO: 41338 - DNA, 777 bp, Neisseria meningitidis; identical to SEQ ID NO: 41336

SEQ ID NO: 41339 - protein, 258 aa, Neisseria meningitidis
MNFIRSVGAKTLGLIQSLGSITLFLLNILAKSGTAFVRPRLSVRQVYFAGVLSVLIVAVSGLFVGMVLGLQGYTQLSKFKSADILGYMVAASLLRELGPVLAAILFASSAGGAMTSEIGLMKTTEQLEAMNVMAVNPVARVVAPRFWAGVFSMPLLASIFNVAGIFGAYLVGVTWLGLDSGIFWSQMQNNITIHYDVINGLIKSAAFGVAVTLIAVHQGFHCVPTSEGILRASTRTVVSSALTILAVDFILTAWMFTD

SEQ ID NO: 41340 - DNA, 777 bp, Neisseria meningitidis
atgaattttatccgttccgtcggggcgaaaaccctcggccttattcaatctctcggcagtatcacgctgtttctgctgaatattctggcgaaatccggtacggctttcgtccgtccgcgcctgagcgtgcgccaagtgtattttgccggcgtgctgtcggtgttgattgttgccgtttcagggctgtttgtcggcatggtcttgggtttgcagggctatacgcagttgtcgaaattcaaatccgccgatattttgggctatatggtcgcggcttcgctgttgcgcgaactgggtccggtgttggcggcgattctgtttgccagcagcgcgggcggtgcgatgaccagcgaaatcggtttgatgaaaacgaccgaacagctcgaagcgatgaacgtgatggcggtaaaccccgtcgcccgagtggttgcgccgcgcttttgggcgggcgtgttttccatgccgcttttggcttcgattttcaacgtggcgggtattttcggcgcgtatttggtcggtgtaacctggctgggcttggacagcggtattttctggtcgcaaatgcagaacaacatcacgatacattacgatgtaatcaacggtctgatcaaatccgccgcgttcggcgtggcggtaacgctgattgccgtgcatcagggcttccactgcgtcccgacctcggaaggcattttgcgcgccagcacgcgcacggtggtttcgtccgccctgacgattttggcggtcgattttatattgaccgcgtggatgtttacagattga

SEQ ID NO: 41341 - protein, 258 aa, Neisseria meningitidis; identical to SEQ ID NO: 41339

SEQ ID NO: 41342 - DNA, 327 bp, Neisseria gonorrhoeae
atgaacatcaaacaccttctcttgaccgccgccgcaaccgcactgttgggcatttccgcccccgcactcgcccaccacgacggacacggcgatgacgaccacggacacgccgcacaccaacacggcaaacaagacaaaatcatcagccgcgcccaagccgaaaaagcggcttgggcgcgtgtcggcggcaaaatcaccgacatcgatctcgaacacgacgacggccgtccgcactatgatgtcgaaatcgtcaaaaacggacaggaatacaaagtcgttgtcgatgcccgtaccggccgcgtgatttcctcccgccgcgacgactga

SEQ ID NO: 41343 - protein, 108 aa, Neisseria meningitidis
MNIKHLLLTAAATALLGISAPALAHHDGHGDDDHGHAAHQHGKQDKIISRAQAEKAAWARVGGKITDIDLEHDDGRPHYDVEIVKNGQEYKVVVDARTGRVISSRRDD

SEQ ID NO: 41344 - DNA, 327 bp, Neisseria meningitidis
atgaacatcaaacaccttctcttgacctccgccgcaaccgcactgctgagcatttccgcccccgcgctcgcccaccacgacggacacggcgatgacgaccacggacacgccgcacaccaacacaacaaacaagacaaaatcatcagccgcgcccaagccgaaaaagcagcgttggcgcgtgtcggcggcaaaatcaccgacatcgatctcgaacacgacaacggccgtccgcactatgatgtcgaaatcgtcaaaaacggacaggaatacaaagtcgttgtcgatgcccgtaccggccgcgtgatttcctcccgccgcgacgactga

SEQ ID NO: 41345 - protein, 108 aa, Neisseria meningitidis
MNIKHLLLTSAATALLSISAPALAHHDGHGDDDHGHAAHQHNKQDKIISRAQAEKAALARVGGKITDIDLEHDNGRPHYDVEIVKNGQEYKVVVDARTGRVISSRRDD

SEQ ID NO: 41346 - DNA, 327 bp, Neisseria meningitidis
atgaacttcaaacgccttctcttgaccgccgccgcaaccgcactgatgggcatttccgcccccgcactcgcccaccacgacggacacggcgatgacgaccacggacacgccgcacaccaacacagcaaacaagacaaaatcatcagccgcgcccaagccgaaaaagcagcgttggcgcgtgtcggcggcaaaatcaccgacatcgatctcgaacacgacaacggccgtccgcactatgatgtcgaaatcgtcaaaaacggacaggaatacaaagtcgttgtcgatgcccgtaccggccgcgtgatttcctcccgccgcgacgactga

SEQ ID NO: 41347 - protein, 108 aa, Neisseria meningitidis
MNFKRLLLTAAATALMGISAPALAHHDGHGDDDHGHAAHQHSKQDKIISRAQAEKAALARVGGKITDIDLEHDNGRPHYDVEIVKNGQEYKVVVDARTGRVISSRRDD

SEQ ID NO: 41348 - DNA, 1815 bp, Neisseria gonorrhoeae
atgtccgctgaaacgaccgtatccggcgcgcgccccgccgccaaactgccgatttacatcctgccctgcttcctttggataggcatcatcccctttaccttcgcactcaggctgaaaccgtcgcccgacttttaccacgatgccgccgccgcggccggcctgattgtcctgttgttcctcacggcaggaaaaaagctgtttgatgtcaaaatccccgccatcagcttcctcctgtttgcaatggcggcattttggtggcttcaggcacgcctgatgaacctgatttatcccggaatgaacgacatcgcctcttgggttttcatcttgctcgccgtcagcgcgtgggcctgcaagagtttggtcgcacactacggacaagaacgcatcgttaccctgtttgcctggtcgctgcttatcggctccctgcttcaatcctgcatcgtcgtcatccagtttgccggctgggaaaacacccccctgcttcaaaacatcatcgttcacagagggcaaggcgtaatcggacacatcgggcagcgcaacaacctcggacactacctcatgtggggcatactcgcctccgcctacctcaacggacaacgaaaaatccccgcagccctcggcgcaatctgcctgattatgcagaccgccgttttaggtttggtcaattcgcgcaccatcttgacctacatagccgccatcgccctcatccttcccttctggtatttccgttcggacaaatccaacagacggacgatgctcggcatagccgcagccgtattccttaccgcgctgttccaattttccatgaacgccattctggaaacctttacaggcatccgctacgaaactgccgtcgaacgcgtcgccaacggcggtttcacagacttgccgcgccaaagcgaatggaataaagcccttgccgccttccagtccgccccgatattcgggcacggctggaacagttttgcccaacaaaccttcctgatcaatgccgaacagcacaccatacacgacaacttcctcagcaccttgttcacccattcccacaacatcatcctccaactccttgcagaaatggggatcagcggcacgcttctggttgccgcaaccctgctgacgggcattgccgggctgctgaaacgctccctgacccccgcatcacttttcctgctgtgcgcgcttgccgtcagtatgtgccacagtatgctcgaatatcctttgtggtatgtctatttcctcatccccttcggactgatgctctttctgtcccccgcagaggcttcagacggcatcgccttcaaaaaagccgccaatctcggcatactgaccgcctccgccgccatattcgcaggattgctgcacttggactggacatacacccggctggttaactccttttcccccgccgctgacgacagtgccaaaaccctcaaccggaaaatcaacgaactgcgctatatttccgcaaacagcccgatgctgtccttttatgccgacttctccctcgtaaacttcgccctgccggaataccccgaaacccagacttgggcggaagaagcaaccctcaaagcactaaaataccgcccctactccgccacctaccgcatcgccctctacttgatgcggcaaggcaaagttgcagaagcaaaacaatggatgcgggcaacacagtcctattacccctacctgatgccccgatacgccgacgaaatccgcaaactgcccgtatgggcaccgctgctgcccgaactgctcaaagactgcaaagccttcgccgccgctcccggccatccggaaacaaaaccctgcaaatga

SEQ ID NO: 41349 - protein, 604 aa, Neisseria gonorrhoeae
MSAETTVSGARPAAKLPIYILPCFLWIGIIPFTFALRLKPSPDFYHDAAAAAGLIVLLFLTAGKKLFDVKIPAISFLLFAMAAFWWLQARLMNLIYPGMNDIASWVFILLAVSAWACKSLVAHYGQERIVTLFAWSLLIGSLLQSCIVVIQFAGWENTPLLQNIIVHRGQGVIGHIGQRNNLGHYLMWGILASAYLNGQRKIPAALGAICLIMQTAVLGLVNSRTILTYIAAIALILPFWYFRSDKSNRRTMLGIAAAVFLTALFQFSMNAILETFTGIRYETAVERVANGGFTDLPRQSEWNKALAAFQSAPIFGHGWNSFAQQTFLINAEQHTIHDNFLSTLFTHSHNIILQLLAEMGISGTLLVAATLLTGIAGLLKRSLTPASLFLLCALAVSMCHSMLEYPLWYVYFLIPFGLMLFLSPAEASDGIAFKKAANLGILTASAAIFAGLLHLDWTYTRLVNSFSPAADDSAKTLNRKINELRYISANSPMLSFYADFSLVNFALPEYPETQTWAEEATLKALKYRPYSATYRIALYLMRQGKVAEAKQWMRATQSYYPYLMPRYADEIRKLPVWAPLLPELLKDCKAFAAAPGHPETKPCK

SEQ ID NO: 41350 - DNA, 1815 bp, Neisseria meningitidis
atgcccgctgaaacgaccgtatccggcgcgcaccccgccgccaaactgccgatttacatcctgccctgcttcctttggataggcatcgtcccctttaccttcgcgctcaaactgaaaccgtcgcccgacttttaccacgatgccgccgccgcagccggcctgattgtcctgttgttcctcacggcaggaaaaaaactgtttgatgtcaaaatccccgccatcagcttccttctgtttgcaatggcggcgttttggtatcttcaggcacgcctgatgaacctgatttaccccggtatgaacgacatcgtctcttggattttcatcttgctcgccgtcagcgcgtgggcctgccggagcttggtcgcacacttcggacaagaacgcatcgtgaccctgtttgcctggtcgctgcttatcggctccctgcttcaatcctgcatcgtcgtcatccagtttgccggctgggaagacacccctctgtttcaaaacatcatcgtttacagcgggcaaggcgtaatcggacacatcgggcagcgcaacaacctcggacactacctcatgtggggcatactcgccgccgcctacctcaacggacaacgaaaaatccccgccgccctcggcgtaatctgcctgattatgcagaccgccgttttaggtttggtcaactcgcgcaccatcttgacctacatagccgccatcgccctcatccttcccttctggtatttccgttcggacaaatccaacaggcggacgatgctcggcatagccgcagccgtattccttaccgcgctgttccaattttccatgaacaccattctggaaacctttactggcatccgctacgaaactgccgtcgaacgcgtcgccaacggcggtttcacagacttgccgcgccaaatcgaatggaataaagcccttgccgccttccagtccgccccgatattcgggcacggctggaacagttttgcccaacaaaccttcctcatcaatgccgaacagcacaacatatacgacaacctcctcagcaacttgttcacccattcccacaacatcgtcctccaactccttgcagagatgggaatcagcggcacgcttctggttgccgcaaccctgctgacgggcattgccgggctgcttaaacgccccctgacccccgcatcgcttttcctaatctgcacgcttgccgtcagtatgtgccacagtatgctcgaatatcctttgtggtatgtctatttcctcatccctttcggactgatgctcttcctgtcccccgcagaggcttcagacggcatcgccttcaaaaaagccgccaatctcggcatactgaccgcctccgccgccatattcgcaggattgctgcacttggactggacatacacccggctggttaacgccttttcccccgccactgacgacagtgccaaaaccctcaaccggaaaatcaacgagttgcgctatatttccgcaaacagtccgatgctgtccttttatgccgacttctccctcgtaaacttcgccctgccggaataccccgaaacccagacttgggcggaagaagcaaccctcaaatcactaaaataccgcccccactccgccacctaccgcatcgccctctacctgatgcggcaaggcaaagttgcagaagcaaaacaatggatgcgggcgacacagtcctattacccgtacctgatgccccgatacgccgacgaaatccgcaaactgcccgtatgggcgccgctgctacccgaactgctcaaagactgcaaagccttcgccgccgcgcccggtcatccggaagcaaaaccctgcaaatga

SEQ ID NO: 41351 - protein, 604 aa, Neisseria meningitidis
MPAETTVSGAHPAAKLPIYILPCFLWIGIVPFTFALKLKPSPDFYHDAAAAAGLIVLLFLTAGKKLFDVKIPAISFLLFAMAAFWYLQARLMNLIYPGMNDIVSWIFILLAVSAWACRSLVAHFGQERIVTLFAWSLLIGSLLQSCIVVIQFAGWEDTPLFQNIIVYSGQGVIGHIGQRNNLGHYLMWGILAAAYLNGQRKIPAALGVICLIMQTAVLGLVNSRTILTYIAAIALILPFWYFRSDKSNRRTMLGIAAAVFLTALFQFSMNTILETFTGIRYETAVERVANGGFTDLPRQIEWNKALAAFQSAPIFGHGWNSFAQQTFLINAEQHNIYDNLLSNLFTHSHNIVLQLLAEMGISGTLLVAATLLTGIAGLLKRPLTPASLFLICTLAVSMCHSMLEYPLWYVYFLIPFGLMLFLSPAEASDGIAFKKAANLGILTASAAIFAGLLHLDWTYTRLVNAFSPATDDSAKTLNRKINELRYISANSPMLSFYADFSLVNFALPEYPETQTWAEEATLKSLKYRPHSATYRIALYLMRQGKVAEAKQWMRATQSYYPYLMPRYADEIRKLPVWAPLLPELLKDCKAFAAAPGHPEAKPCK

SEQ ID NO: 41352 - DNA, 1815 bp, Neisseria meningitidis
atgcccgctgaaacgaccgtatccggcgcgcaccccgccgccaaactgccgatttacatcctgccctgcttcctttggataggcatcgtcccctttacctttgcgctcaggctgcaaccgtcgcccgacttttaccacgatgccgccgccgcagccggcctgattgtcctgttgttcctcacggcaggaaaaaagctgtttgatgtcaaaatcccacctatcagcttccttctgtttgcaatggcggcgttttggtatcttcaggcacgcctgatgaacctgatttaccccggtatgaacgacatcgtctcttggattttcatcttactcgccgtcagcgcgtgggcctgccggagcttggtcgcacactacggacaagaacgcatcgttaccctgtttgcctggtcgctgcttatcggctccctgcttcaatcctgcatcgtcgtcatccagtttgccggctgggaagacacccctctgtttcaaaacatcattgtttacagcgggcaaggcgtaatcggacacatcggacagcgcaacaacctcggacactacctcatgtggggcatactcgccgccgcctacctcaacggacaacgaaaaatcccgcccgccttgggtgcaatctgcctgattatgcagaccgccgttttaggtttggtcaattcgcgcaccatcttgacctacatagccgccatcgccctcatccttcccttctggtatttccgttcggacaaatccaacaggcggacgatactcggcatagccgcagccgtattccttaccgcgctgttccaattttccatgaacaccattctggaaacctttaccggcatccgctacgaaaccgccgtcgaacgcgtcgccaacggcggtttcacagacctgccgcgccaaatcgaatggcgcaaagccctcgccgccttccagtccgccccgatattcgggcacggctggaacagttttgcccaacaaaccttcctcatcaatgccgaacagcacaacatacacgacaacctcctcagcaacttgttcacccattcccacaacatcgttctccaactccttgcagagatggggatcagcggcacgcttctggttgccgcaaccctgctgacgggcattgccgggctgctgaaacgccccctgacccccgcatcgcttttcctgatctgcacacttgccgtcagtatgtgccacagtatgctcgaatatcctttgtggtatgtctatttcctcatccccttcggactgatgctctttctgtcccccgcagaggcttcagacggcatcgccttcaaaaaagccgccaatctcggcatactaaccgcctccgccgccatattcgcaggattgctgcacttggactggacatacacccggatggttaacgccttttcccccgccactgacgacagtgccaaaaccctcaaccggaaaatcaacgagttgcgctatatttccgcaaacagtccgatgctgtccttttatgccgacttctccctcgtaaacttcgccctgccggaataccccgaaacccagacttgggcggaagaagcaaccctcaaatcactaaaataccgcccccactccgccacctaccgcatcgccctctacctgatgcggcaaggcaaagttgcagaagcaaaacaatggatgcgggcgacacagtcctattacccctacctgatgccccgatacgccgacgaaatccgcaaactgcccgtatgggcgccgctgctacccgaactgctcaaagactgcaaagccttcgccgccgcgcccggtcatccggaagcaaaaccctgcaaatga

SEQ ID NO: 41353 - protein, 604 aa, Neisseria meningitidis
MPAETTVSGAHPAAKLPIYILPCFLWIGIVPFTFALRLQPSPDFYHDAAAAAGLIVLLFLTAGKKLFDVKIPPISFLLFAMAAFWYLQARLMNLIYPGMNDIVSWIFILLAVSAWACRSLVAHYGQERIVTLFAWSLLIGSLLQSCIVVIQFAGWEDTPLFQNIIVYSGQGVIGHIGQRNNLGHYLMWGILAAAYLNGQRKIPPALGAICLIMQTAVLGLVNSRTILTYIAAIALILPFWYFRSDKSNRRTILGIAAAVFLTALFQFSMNTILETFTGIRYETAVERVANGGFTDLPRQIEWRKALAAFQSAPIFGHGWNSFAQQTFLINAEQHNIHDNLLSNLFTHSHNIVLQLLAEMGISGTLLVAATLLTGIAGLLKRPLTPASLFLICTLAVSMCHSMLEYPLWYVYFLIPFGLMLFLSPAEASDGIAFKKAANLGILTASAAIFAGLLHLDWTYTRMVNAFSPATDDSAKTLNRKINELRYISANSPMLSFYADFSLVNFALPEYPETQTWAEEATLKSLKYRPHSATYRIALYLMRQGKVAEAKQWMRATQSYYPYLMPRYADEIRKLPVWAPLLPELLKDCKAFAAAPGHPEAKPCK

SEQ ID NO: 41354 - DNA, 594 bp, Neisseria gonorrhoeae
atggcaaaaaaaccgaacaaacccttcaggctgacccccaaactcctgatacgcgccgtattgctcatctgtatcaccgccatcggcgcattggcagtaggcatcgtcagcacattcaacccgaacggcgacaaaaccctccaaaccgaaccgcaacacaccgacagcccccgcgaaaccgaattctggctgccaaacggcgccgtcggacaagatgccgcccaacccgaacaccaccacgccgcctcatccgaacccgcacagccggacggcacagaagaaagcggcagcggactgccgtcccctgccgcacccaagaaaaaccgggtcaaaccgcgcccttcggatgcggcccgggcagccgattcgttaaccggcaccggaacacaagctgaaaacacactcaaagaaacccccgtactgcccacaaacgccccccatcccgaaccccgaaaagaaacacccgaaaaacaggcgcagcccaaagaaacacccaaagaaaaagaaacgcccaaagaaaaccataccaaaccggacaccccgaaaaacacgccggccaaaccccataaagagattctcgacaacctcttttga

SEQ ID NO: 41355 - protein, 197 aa, Neisseria gonorrhoeae
MAKKPNKPFRLTPKLLIRAVLLICITAIGALAVGIVSTFNPNGDKTLQTEPQHTDSPRETEFWLPNGAVGQDAAQPEHHHAASSEPAQPDGTEESGSGLPSPAAPKKNRVKPRPSDAARAADSLTGTGTQAENTLKETPVLPTNAPHPEPRKETPEKQAQPKETPKEKETPKENHTKPDTPKNTPAKPHKEILDNLF

SEQ ID NO: 41356 - DNA, 573 bp, Neisseria meningitidis
atggcaaaaaaaccgaacaaacccttcaggctgacccccaaactcctgatacgcgccgtattgctcatctgtatcgccgccatcggcgcattggcaataggcatcgtcagcacattcaacccgaacggcgacaaaacccttcaagccgaaccgcaacacaccgacagcccccgcgaaaccgaattctggctgccaaacggcgtagtcggacaagatgccgcccaacccgaacaccaccacgccgcctcatccgaacccgcacagccggacggcacagacgaaagcggcagcggactgccgtcccctgccgcacccaagaaaaaccgggtcaaaccgcaacctgccgacacagctcaaaccgacaggcagccggacgacgccggaacacaagctgaaaacacactcaaagaaacccccgtactgcccacaaacgtcccccgtcccgaaccccgaaaagaaacacccgaaaaacaggcgcagcccaaagaaacgcccaaagaaaaccataccaaaccggacaccccgaaaaacacgccgcccaaaccccataaagaaattctcgacaaactcttc

SEQ ID NO: 41357 - protein, 191 aa, Neisseria meningitidis
MAKKPNKPFRLTPKLLIRAVLLICIAAIGALAIGIVSTFNPNGDKTLQAEPQHTDSPRETEFWLPNGVVGQDAAQPEHHHAASSEPAQPDGTDESGSGLPSPAAPKKNRVKPQPADTAQTDRQPDDAGTQAENTLKETPVLPTNVPRPEPRKETPEKQAQPKETPKENHTKPDTPKNTPPKPHKEILDKLF

SEQ ID NO: 41358 - DNA, 594 bp, Neisseria meningitidis
atggcaaaaaaaccgaacaaacccttcaggctgacccccaaactcctgatacgcgccgtattgctcatctgtatcaccgccatcggcgcattggcaataggcatcgtcagcacattcaacccgaacggcgacaaaaccctccaaaccgaaccgcaacacaccgacagcccccgcgaaaccgaattctggctgccaaacggcgtagtcggacaagatgccgcccaacccgaacaccaccacgcctcctcatccgcacccgcacagccggacggcacagacgaaagcggcagcggactgccgtcccctgccgcacccaagaaaaaccgggtcaaaccgcaacctgccgacacagctcaaaccgacaggcagccggacgacgccggagcacaagctgaaaacacactcaaagaaacccccgtactgcccacaaacgtcccccgtcccgaaccccgaaaagaaacacccgaaaaacaggcacagcccaaagaaacacccaaagaaaaagaaacgcccaaagaaaaccataccaaaccggacaccccgaaaaacacgccgcctaaaccccataaagaaattctcgacaacctcttctga

SEQ ID NO: 41359 - protein, 197 aa, Neisseria meningitidis
MAKKPNKPFRLTPKLLIRAVLLICITAIGALAIGIVSTFNPNGDKTLQTEPQHTDSPRETEFWLPNGVVGQDAAQPEHHHASSSAPAQPDGTDESGSGLPSPAAPKKNRVKPQPADTAQTDRQPDDAGAQAENTLKETPVLPTNVPRPEPRKETPEKQAQPKETPKEKETPKENHTKPDTPKNTPPKPHKEILDNLF

SEQ ID NO: 41360 - DNA, 279 bp, Neisseria gonorrhoeae
atgtcccgaaacctgcttgtccgctggctcgccgtctgcctcatccccttggcgacgcttgccgttttcgccgccaatccgcccgaagacaaaccccagcatctgatcaacggcatcatccttgcctgcgaagcgacgtttttgtttaaattcgtgctctttgaaaccatcaagcatcatcttaaacaagggtttgatttgaaacgtcaaaccatgtttctgtttattccgattgttttgctggttgtgtatttgttccactatttcggcgcgttttag

SEQ ID NO: 41361 - protein, 92 aa, Neisseria gonorrhoeae
MSRNLLVRWLAVCLIPLATLAVFAANPPEDKPQHLINGIILACEATFLFKFVLFETIKHHLKQGFDLKRQTMFLFIPIVLLVVYLFHYFGAF

SEQ ID NO: 41362 - DNA, 279 bp, Neisseria meningitidis
atgtcccgaaacctgcttgtccgctggcttgccgtctgcctcatcccgttggcgacgcttgccgttttcgccgccaatccgcccgaagacaaactccagcatctgatcaacggcatcatccttgcctgcgaagcgacgtttttgtttaaattcgtccttttcgacaccatcaagcatcatttgaaacaagagtttgatttgaaacgtcaaactatgttgctgtttattccgattattttgctgattgtgtatttgttccactattttggcgcgttttag

SEQ ID NO: 41363 - protein, 92 aa, Neisseria meningitidis
MSRNLLVRWLAVCLIPLATLAVFAANPPEDKLQHLINGIILACEATFLFKFVLFDTIKHHLKQEFDLKRQTMLLFIPIILLIVYLFHYFGAF

SEQ ID NO: 41364 - DNA, 279 bp, Neisseria meningitidis
atgtcccgaaacctgcttgtccgctggcttgtcgtctgcctgatacccttggcgacgcttgccgttttcgccgccaatccgcccgaagacaaaccccagcatctgattaacggcatcatccttgcctgcgaagcgacgtttttgttcaaattcgtccttttcgacaccatcaagcatcatttgaaacaagagtttgatttgaaacgtcaaactatgttgctgtttattccgattattttgctgattgtgtatttgttccactattttggcgcgttttag

SEQ ID NO: 41365 - protein, 92 aa, Neisseria meningitidis
MSRNLLVRWLVVCLIPLATLAVFAANPPEDKPQHLINGIILACEATFLFKFVLFDTIKHHLKQEFDLKRQTMLLFIPIILLIVYLFHYFGAF

SEQ ID NO: 41366 - DNA, 840 bp, Neisseria gonorrhoeae
gtgaaccgaactaccttctgctgcctttctttgaccgccggccctgattctgaccgcctgcagcagcggaggggcggaggcggtggtgtcgccgccgacatcggcacggggcttgccgatgcattaaccgcgccgctcgaccataaagacaaaggtttgaaatccctaacattggaagcctccattccccaaaacggaacactgaccctgtcggcacaaggtgcggaaaaaactttcaaagccggcggcaaagacaacagcctcaacacgggcaaactgaagaacgacaaaatcagccgcttcgacttcgtgcaaaaaatcgaagtggacggacaaaccatcacactggcaagcggcgaatttcaaatatacaaacaggatcactccgccgtcgttgccctacggattgaaaaaatcaacaaccccgacaaaatcgacagcctgataaaccaacgctccttccttgtcagcgatttgggcggagaacataccgccttcaaccaactgcctgacggcaaagccgagtatcacggcaaagcattcagctccgacgatgccgacggaaaactgacctataccatagatttcgccgccaaacagggacacggcaaaatcgaacacctgaaaacacccgagcagaatgttgagcttgcctccgccgaactcaaagcagatgaaaaatcacacgccgtcattttgggcgacacgcgctacggcggcgaagagaaaggcacttaccgcctcgcccttttcggcgaccgcgcccaagaaatcgctggctcggcaaccgtgaagataggggaaaaggttcacgaaatcggcatcgccgacaaacagtag

SEQ ID NO: 41367 - protein, 279 aa, Neisseria gonorrhoeae
VNRTTFCCLSLTAGPDSDRLQQRRGGGGGVAADIGTGLADALTAPLDHKDKGLKSLTLEASIPQNGTLTLSAQGAEKTFKAGGKDNSLNTGKLKNDKISRFDFVQKIEVDGQTITLASGEFQIYKQDHSAVVALRIEKINNPDKIDSLINQRSFLVSDLGGEHTAFNQLPDGKAEYHGKAFSSDDADGKLTYTIDFAAKQGHGKIEHLKTPEQNVELASAELKADEKSHAVILGDTRYGGEEKGTYRLALFGDRAQEIAGSATVKIGEKVHEIGIADKQ

SEQ ID NO: 41368 - DNA, 825 bp, Neisseria meningitidis
gtgaatcgaactgccttctgctgcctttctctgaccactgccctgattctgaccgcctgcagcagcggagggggtggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggtgacagcctcaatacgggcaaattgaagaacgacaaggtcagccgtttcgactttatccgccaaatcgaagtggacgggcagctcattaccttggagagtggagagttccaagtatacaaacaaagccattccgccttaaccgcctttcagaccgagcaaatacaagattcggagcattccgggaagatggttgcgaaacgccagttcagaatcggcgacatagcgggcgaacatacatcttttgacaagcttcccgaaggcggcagggcgacatatcgcgggacggcgttcggttcagacgatgccggcggaaaactgacctacaccatagatttcgccgccaagcagggaaacggcaaaatcgaacatttgaaatcgccagaactcaatgtcgacctggccgccgccgatatcaagccggatggaaaacgccatgccgtcatcagcggttccgtcctttacaaccaagccgagaaaggcagttactccctcggtatctttggcggaaaagcccaggaagttgccggcagcgcggaagtgaaaaccgtaaacggcatacgccatatcggccttgccgccaagcaataa

SEQ ID NO: 41369 - protein, 274 aa, Neisseria meningitidis
VNRTAFCCLSLTTALILTACSSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 41370 - DNA, 825 bp, Neisseria meningitidis
gtgaaccgaactgccttctgctgcctttctttgaccgccgccctgattctgaccgcctgcagcagcggaggcggcggtgtcgccgccgacatcggcgcggtgcttgccgatgcactaaccgcaccgctcgaccataaagacaaaagtttgcagtctttgacgctggatcagtccgtcaggaaaaacgagaaactgaagctggcggcacaaggtgcggaaaaaacttatggaaacggcgacagcctcaatacgggcaaattgaagaacgacaaggtcagccgcttcgactttatccgtcaaatcgaagtggacgggcagctcattaccttggagagcggagagttccaagtgtacaaacaaagccattccgccttaaccgcccttcagaccgagcaagtacaagattcggagcattcagggaagatggttgcgaaacgccagttcagaatcggcgatatagcgggtgaacatacatcttttgacaagcttcccgaaggcggcagggcgacatatcgcgggacggcattcggttcagacgatgccagtggaaaactgacctacaccatagatttcgccgccaagcagggacacggcaaaatcgaacatttgaaatcgccagaactcaatgttgacctggccgcctccgatatcaagccggataaaaaacgccatgccgtcatcagcggttccgtcctttacaaccaagccgagaaaggcagttactctctaggcatctttggcgggcaagcccaggaagttgccggcagcgcagaagtggaaaccgcaaacggcatacgccatatcggtcttgccgccaagcagtaa

SEQ ID NO: 41371 - protein, 274 aa, Neisseria meningitidis
VNRTAFCCLSLTAALILTACSSGGGGVAADIGAVLADALTAPLDHKDKSLQSLTLDQSVRKNEKLKLAAQGAEKTYGNGDSLNTGKLKNDKVSRFDFIRQIEVDGQLITLESGEFQVYKQSHSALTALQTEQVQDSEHSGKMVAKRQFRIGDIAGEHTSFDKLPEGGRATYRGTAFGSDDASGKLTYTIDFAAKQGHGKIEHLKSPELNVDLAASDIKPDKKRHAVISGSVLYNQAEKGSYSLGIFGGQAQEVAGSAEVETANGIRHIGLAAKQ

SEQ ID NO: 41372 - DNA, 2352 bp, Neisseria meningitidis
atggtttacggcattgccgaagccgatgcgggcgacagcagtgtgcttactttgggcggcatgtatcagaagagtagggaggttcctgatttttcgggcattattttgccctgtgaaaatcagaaaactgccccgttcagttcaacgcctgcctgcaaccggcctttgcaactgccgcgcaacacttatttgggggaggattggtcgcggttaagtgccgacaaatacaaccttttctcaggattcaaacatgtgtttgacaacggttggcagctcaatgccgaagtgtcttataccaagaatgaatccgatgcgaaggtggggcagttttttctgaaaaacgaatatgcggcgggtttgtcgggtgaggatgcggtaggctttttgactgaaaaaaacgaagtcatcccgttcgagccgaaagataaggcattggagaaactgaaagcatatcgtgatgaaaccgccaaggaataccgggagcgcaaagacgattttgttaaaaaccgtttcgataatactgctttcgaacagtatcgcagccgccgtgccgcagaacgcaaagccggttttgacaagtgtatgagtgaccctttcgcgctggactttatctgtcaaggttcttggggggatccgggcgttgatgccgacaaggcggaatttgtcgataaagcccttgcgaaggagggcatctttaataatgcggcacaacgttttccaaacagcctgtatgactcttcctttaatcggaaggctaccgccaaccgacgatacagttatatgccgttgcggcataccaaagacgaccgccaatggggaattaaacttgacctgaccggcacatatgggctgttcgggcgggagcatgatttctttgtcggctatgcctacggtgatgaaaagatacgttcggaatatctagaaatctacgaacgccgctacagagtacgtccgaatacgggggcaacgcacggcgtgtatgcgggaagttgtcaggaggagccggacggcgatttgtcgtctcctttggtcagggggcataaagaacccgattggcaggcgtacgatgaaaaaggcaaccgtaccgtttatgccgaagaatgcaggaacgccaagaaaataaaaaccgagcccaagctcgatgccgaaggcaagcaggtgtattactatgacgaatacagcggcagccggacaccggtatatgtcgatgtatatgagctggacgaaaaaggcaacaagattcaggagaccaatcccgacggcacgcctgcctttaccggtttttccggtacggtgccggtttggaaaaccgtcaaagtggcagacgaccatgttcctgcgctgtataactacgccaaatacctcaacaccaacaaaacccattcgctgactgccagcacgcgtttcaacgtaaccggccgactgcaccttttgggcgggctgcactacacgcgctatgagacttcgcaaaccaaagatatgcctgtccgctatgggcagccggcaagcgattttcagacggcatcgagcattagggcggatcaggaccattacacggccaagatgcaaggtcataaattgacgccctatgcaggcattacctatgacttgacaccgcaacagagtatttacggaagttataccaaaatcttcaaacagcaggataatgtcgatgtcagtgccaaaaccgttttaccgcctttggtcggcacaaactatgaggtaggctggaaaggcgcgttcttgcaaggacggctgaatgcttcgttcgcattgttttacctcgaacagaaaaaccgcacggtcgtcgatttcggctatgttcccggagcaggcggcaagcaggggtcgttccaaaccgttgccaaaccgataggcaaagtggtcagcaggggtgcggaattcgagttgtcgggtgagttgaacgaagattggaaagtctttgcgggttacacctacaacaagagccgctacaaaaacgccgccgaagtcaacgccgaacgccttgccaaaaattccagtgcagacccgtacaacttcagcaatttcacacccgtgcacatattccgtttcggaacgagcttccatataccgaatacggggctgaccgtcggcggcggcgtgtccgcacaaagcggcacaagcagtctgtataacatcaggcagggcggctacgggctgatagacggtttcgtccgttacgaattgggcaaacacgccaaattgagcctcatcggtacgaacttaaacggacgcacttattttgagaacaactacaaccgtacgcgcggcgcaaacaacttctacggagagccgcgcactgtcagcatgaaactggattggcagttttaa

SEQ ID NO: 41373 - protein, 783 aa, Neisseria meningitidis
MVYGIAEADAGDSSVLTLGGMYQKSREVPDFSGIILPCENQKTAPFSSTPACNRPLQLPRNTYLGEDWSRLSADKYNLFSGFKHVFDNGWQLNAEVSYTKNESDAKVGQFFLKNEYAAGLSGEDAVGFLTEKNEVIPFEPKDKALEKLKAYRDETAKEYRERKDDFVKNRFDNTAFEQYRSRRAAERKAGFDKCMSDPFALDFICQGSWGDPGVDADKAEFVDKALAKEGIFNNAAQRFPNSLYDSSFNRKATANRRYSYMPLRHTKDDRQWGIKLDLTGTYGLFGREHDFFVGYAYGDEKIRSEYLEIYERRYRVRPNTGATHGVYAGSCQEEPDGDLSSPLVRGHKEPDWQAYDEKGNRTVYAEECRNAKKIKTEPKLDAEGKQVYYYDEYSGSRTPVYVDVYELDEKGNKIQETNPDGTPAFTGFSGTVPVWKTVKVADDHVPALYNYAKYLNTNKTHSLTASTRFNVTGRLHLLGGLHYTRYETSQTKDMPVRYGQPASDFQTASSIRADQDHYTAKMQGHKLTPYAGITYDLTPQQSIYGSYTKIFKQQDNVDVSAKTVLPPLVGTNYEVGWKGAFLQGRLNASFALFYLEQKNRTVVDFGYVPGAGGKQGSFQTVAKPIGKVVSRGAEFELSGELNEDWKVFAGYTYNKSRYKNAAEVNAERLAKNSSADPYNFSNFTPVHIFRFGTSFHIPNTGLTVGGGVSAQSGTSSLYNIRQGGYGLIDGFVRYELGKHAKLSLIGTNLNGRTYFENNYNRTRGANNFYGEPRTVSMKLDWQF

SEQ ID NO: 41374 - DNA, 2352 bp, Neisseria meningitidis
atggtttacggcattgccgaagccgatgcgggcgacagcagtgtgcttactttgggcggcatgtatcagaagagtagggaggttcctgatttttcgggcattattttgtcctgtgaaaatcagaaaactgccccgttcagttcaacgcctgcctgcaaccggcctttgcaactgccgcgcaacacttatttgggggaggattggtcgcggttgagtgctgacaaatacaaccttttctcaggtttcaaacatgtgtttgacaacggttggcagctcaatgccgaagtgtcttataccaagaatgaatccgatgcgaaggtggggcagttttttctgaaaaacgaacatgcggcgggtttgtcagatgaggatgcggtaggctttttgaccgaaaaaaacgaagtcatcccgttcgagccgaaagataaggcattggagaaactgaaagcatatcgtgacgaaaccgccaaggaataccgtgagcgcaaagacgattttgttaaaaaccgtttcgataatactgctttcgagcagtaccgcagccgccgtgccgcagaacgcaaagccggttttgacgagtgtatgagtgccccttttgcgctggactttatctgtcaaggttcttggggggatccgggtgttgatgccgacaagtcggaatttgtcgataaagcccttgcgaaggaaggcatctttaataatgcggcacaacgttttccaaacagcctgtatgactcttcctttaatcggaaggctaccgccaaccgacgatacagttatatgccgttgcggcataccaaagacgaccgccaatggggaattaaacttgacctgaccggcacatatgggctgttcgggcgggagcatgatttctttgtcggctatgcctacggcgatgaaaagatacgttccgaatatctggaaatctacgaacgccgccacagagtacgtccgaatacaggggcaacgcacggcgtgtatgcgggaagttgtcagggggagccggacggtgatttgtcttctcctttggtcagggggcataaagaacccgattggcaggcgtacgatgaaaaaggcaaccgtaccgtttatgccgaagaatgcaggaatgccaagaaaataaaaaccgagcccaagctcgatgccgaaggcaagcaggtgtattactatgacgaatacagcggcagccggacgccagtatatgtcgatgtatatgaactggatgaaaaaggcaataagattcaggagaccaatcccgacggcacgcctgcctttaccggtttttccggtacggtgccggtttggaaaaccgtcaaagtggccgacgaccatgttcctgcgctgtataactacgccaaatacctcaacaccaacaaaacccattcgctgactgccggcacgcgtttcaacgtaaccggccgactgcatcttttgggcgggctgcactacacgcgctatgaaacctcgcaaaccaaagatatgcctgtccgctatgggcagccggcaagcgattttcagacggcatcgagcattaaggcggatcaggaccattatacggccaagatgcaaggtcataaattgacgccctatgcaggcattacctatgatttgacaccgcaacagagtatttacggaagttataccaaaatcttcaaacagcaggataatgtcgatgtcagtgccaaaaccgttttaccgcctttggtcggcacaaactatgaggtaggctggaaaggcgcgttcttgcaaggacggctgaatgcttcgttcgcattgttttacctcgaacagaaaaaccgcacggtcgtcgattttggctatgttcccggagcaggcggcaagcaggggtcgttccaaaccgttgccaaaccgataggcaaagtggtcagcaggggtgcggaattcgagttgtcgggtgagttgaacgaagattggaaagtctttgcgggttacacctacaacaagagccgctacaaaaacgccgccgaagtcaacgccgaacgcctcgccaaaaacacaggcgcagacccgtacaacttcagcaatttcacacccgtgcacatattccgtttcggaacgagcttccatataccgaatacggggctgaccgtcggcggcggcgtgtccgcacaaagcggcacaagcagtctgtataacatcaggcagggcggctacgggctgatagacggtttcgtccgttacgaattgggcaaacacgctaaattgagcctcatcggtacgaacttaaacggacgcacttattttgagaacaactacaaccgtacgcgcggcgcaaacaacttctatggagagccgcgcactgtcagcatgaaactggattggcagttttaa

SEQ ID NO: 41375 - protein, 783 aa, Neisseria meningitidis
MVYGIAEADAGDSSVLTLGGMYQKSREVPDFSGIILSCENQKTAPFSSTPACNRPLQLPRNTYLGEDWSRLSADKYNLFSGFKHVFDNGWQLNAEVSYTKNESDAKVGQFFLKNEHAAGLSDEDAVGFLTEKNEVIPFEPKDKALEKLKAYRDETAKEYRERKDDFVKNRFDNTAFEQYRSRRAAERKAGFDECMSAPFALDFICQGSWGDPGVDADKSEFVDKALAKEGIFNNAAQRFPNSLYDSSFNRKATANRRYSYMPLRHTKDDRQWGIKLDLTGTYGLFGREHDFFVGYAYGDEKIRSEYLEIYERRHRVRPNTGATHGVYAGSCQGEPDGDLSSPLVRGHKEPDWQAYDEKGNRTVYAEECRNAKKIKTEPKLDAEGKQVYYYDEYSGSRTPVYVDVYELDEKGNKIQETNPDGTPAFTGFSGTVPVWKTVKVADDHVPALYNYAKYLNTNKTHSLTAGTRFNVTGRLHLLGGLHYTRYETSQTKDMPVRYGQPASDFQTASSIKADQDHYTAKMQGHKLTPYAGITYDLTPQQSIYGSYTKIFKQQDNVDVSAKTVLPPLVGTNYEVGWKGAFLQGRLNASFALFYLEQKNRTVVDFGYVPGAGGKQGSFQTVAKPIGKVVSRGAEFELSGELNEDWKVFAGYTYNKSRYKNAAEVNAERLAKNTGADPYNFSNFTPVHIFRFGTSFHIPNTGLTVGGGVSAQSGTSSLYNIRQGGYGLIDGFVRYELGKHAKLSLIGTNLNGRTYFENNYNRTRGANNFYGEPRTVSMKLDWQF

SEQ ID NO: 41376 - DNA, 564 bp, Neisseria meningitidis
atgaatcaaaatcatttttcacttaaaattctgaccgttatgctgttatcggcttacggtggttcttttgcagacggtgttgtgcctgtttcagacggcaataccgtcagtctggatacggtcaatgtacgcggctctcatgctttgttgggcaagaccgaaaagacccgttcttatacgatagatcggatgtccaccgccacaggtatgaggattgcgggcaaggatacgccgcagtcggtcagcgtcatcacgcgcagccgccttgacgataaggcggtgcatacgcttgaagaggcaatgaaaaacacgacgggtgtcaacgttgtgcgcgattcaggcttgcagacgcggtttttgtcacgcggtttctatattgatcagattggtgaagacggtatgaccgtcaatgttgcaggccgttcgggatatacggcgaaaatcgacgtgtctccgagtaccgatttggcggtttatgaccatattgaagttgtacggggtgcaacggggttgacccaatccaattcagagccgggaggaaccgtcaatttgatccgtaagtga

SEQ ID NO: 41377 - protein, 187 aa, Neisseria meningitidis
MNQNHFSLKILTVMLLSAYGGSFADGVVPVSDGNTVSLDTVNVRGSHALLGKTEKTRSYTIDRMSTATGMRIAGKDTPQSVSVITRSRLDDKAVHTLEEAMKNTTGVNVVRDSGLQTRFLSRGFYIDQIGEDGMTVNVAGRSGYTAKIDVSPSTDLAVYDHIEVVRGATGLTQSNSEPGGTVNLIRK

SEQ ID NO: 41378 - DNA, 564 bp, Neisseria meningitidis
atgaatcaaaatcatttttcacttaaaattctgaccgttatgctgttatcggcttacggtggttcttttgcagacggtgttgtgcctgtttcagacggcaataccgtcagtttggatacggtcaatgtacgcggctctcatgctctgtcgggcaagaccgagaagacccgttcttatacgatagatcggatgtccaccgccacaggtatgaggattgcgggcaaggatacgccgcagtcggtcagcgtcatcacgcgcagccgccttgacgataaggcggtgcatacgcttgaagaggcaatgaaaaacacgacgggtgtcaacgttgtgcgcgattcaggcttgcagacgcggtttttgtcacgcggtttctatattgatcagattggtgaagacggtattaccgtcaatgttgcaggccgttcgggatatacggcgaaaatcgacgtgtctccgagtaccgatttggcggtttatgaccatattgaagttgtacggggtgcaacggggttgacccaatccaattcagagccgggtggaaccgtcaatttgatccgtaagcga

SEQ ID NO: 41379 - protein, 188 aa, Neisseria meningitidis
MNQNHFSLKILTVMLLSAYGGSFADGVVPVSDGNTVSLDTVNVRGSHALSGKTEKTRSYTIDRMSTATGMRIAGKDTPQSVSVITRSRLDDKAVHTLEEAMKNTTGVNVVRDSGLQTRFLSRGFYIDQIGEDGITVNVAGRSGYTAKIDVSPSTDLAVYDHIEVVRGATGLTQSNSEPGGTVNLIRKR

SEQ ID NO: 41380 - DNA, 1596 bp, Neisseria meningitidis
atgaaaccgttaaaaacattagaatttggatttgtggatgctgcaaactacagaagaagagaaaataaagatttatttaaccgaatatttgtaaaaggagaatatttggatgaattatgtgaaccaaatatttcgtttttaatcggagaaaagggaactggaaagacagcatatgctgtttatttaactaataacttctataaaaacatacatgccactactaagtttgttcgtgaaaccgattattcaaaatttattcagctaaagaaagcaagacacttaactgtttcagattttacaagtatttggaaagtcattttatatctgttgatatcaaatcaaatcaaatgtaaagaaaacggaatattatcttcaatatttaataaatttaaagccttagatgaggctataaatgaatattattatggcgcttttgatccggaaattgtacaagcaataactttaatagaaaattcaaaagaagctgcggaaatgatttttggaaaatttgttaaactaggtgaagaggaatcccaacaaataacttttacagaaagtaaattccaagcaaatttaggttttattgaaagaaaatttaaagatgctttatctcagttaaagctaaaagataatcatattttgtttattgatgggatagatattagaccatcacagattccatttgatgaatatcatgagtgtgtaaaaggtcttgctaacgccatatggatgttaaataatgatatcttcccttccattaaagatagtaagggaaggatgagagttgtgttattgattagacctgatatctttgattcattaggtttacaaaatcaaaataccaaacttcaagataattcagtatttttagactggaggacggattataaatcttatagaagttcaaagatttttggcgtttttgatcatcttttgagaacccagcaagaaaaacaagatagtttagaaaaaggcaactcatgggattattattttccatggaatgctcctaatttacatgatgagtataaaaatttaacttcatttattagcttcctaagaaaatcgtattatcgacctcgcgatattcttcagatgcttactttgctacaaaaaaataagaaaagtaaggaagattatgtcgtagcagaagattttgataatacttcttttcaaagagaatactcgatatatttacttggtgaaatcaaagatcatcttttgttttattatagtcaaagtgattatcaaaatttcctgaaattttttgaatttttaaacgggaaagatagatttaaatatagtgattttttaaaagcatttgaacgtttgaaaaagcacttacaaacaacatcagtggaaatacctaaatttatgagtactgctaatgagtttttgcaatttttatttgacttgaatgttattgcttatttagataacccagaagatgaaacgaaaccatatatccattggtgctttaaagatagaaattatgcaaatatttctcctaaaataaaaactgaaactgaatatttaatattttcaggattatcaaaagcccttgatgttggtactccatttaagaacaaacagtaa

SEQ ID NO: 41381 - protein, 531 aa, Neisseria meningitidis
MKPLKTLEFGFVDAANYRRRENKDLFNRIFVKGEYLDELCEPNISFLIGEKGTGKTAYAVYLTNNFYKNIHATTKFVRETDYSKFIQLKKARHLTVSDFTSIWKVILYLLISNQIKCKENGILSSIFNKFKALDEAINEYYYGAFDPEIVQAITLIENSKEAAEMIFGKFVKLGEEESQQITFTESKFQANLGFIERKFKDALSQLKLKDNHILFIDGIDIRPSQIPFDEYHECVKGLANAIWMLNNDIFPSIKDSKGRMRVVLLIRPDIFDSLGLQNQNTKLQDNSVFLDWRTDYKSYRSSKIFGVFDHLLRTQQEKQDSLEKGNSWDYYFPWNAPNLHDEYKNLTSFISFLRKSYYRPRDILQMLTLLQKNKKSKEDYVVAEDFDNTSFQREYSIYLLGEIKDHLLFYYSQSDYQNFLKFFEFLNGKDRFKYSDFLKAFERLKKHLQTTSVEIPKFMSTANEFLQFLFDLNVIAYLDNPEDETKPYIHWCFKDRNYANISPKIKTETEYLIFSGLSKALDVGTPFKNKQ

SEQ ID NO: 41382 - DNA, 492 bp, Neisseria meningitidis
atgttttggcaactgaccgttgtttcagtaaccgccgtcattgcactggggacaatattcatcaataagaaaacttcaaagcaaaaggcgacattagatgttattttgaatgattaccaagatgcacaatttgtagaagccgacaatcatatttcgccttatattcgcggcacggcagttgacgacaacaacgcgcggatcgacctgtatgaaatttatcaaaataagggcggacaatgggaaaaagagagagggcatttacttaccgtaatcaatcggcacgagttttatgcgtgcgcaatcaactcgggagtattggatgaggatttgtttaaacggctgcattgcaccaacttcataaaattgtggaatgcagtttcgcctcttgttatgaaaatacgcgaagaagaacgcaaagacacaatatttagagagttggaaattttggttgcattatggaaagcaaaccccctaaaggcatctgatttgtga

SEQ ID NO: 41383 - protein, 163 aa, Neisseria meningitidis
MFWQLTVVSVTAVIALGTIFINKKTSKQKATLDVILNDYQDAQFVEADNHISPYIRGTAVDDNNARIDLYEIYQNKGGQWEKERGHLLTVINRHEFYACAINSGVLDEDLFKRLHCTNFIKLWNAVSPLVMKIREEERKDTIFRELEILVALWKANPLKASDL

SEQ ID NO: 41384 - DNA, 1041 bp, Neisseria gonorrhoeae
atgtccgaaaacaaacaaaacgaagtcctgaccggttacgaacagctgaaacggcgcaaccgccgccgcctcgtaacggcaagctccctggttgccgcctcctgcatcctgctggcagccgcactcagttccgatcctgccgacagcaatcccgcaccgcaggccggcgaaaccggcgcaacggaaagccaaacggcaaacacggcacaaacccctgccttgaaatccgccgccgaaaacggggaaaccgccgccgacaaaccgcaggacttggcaggcgaagacaagccttctgccgccgacagcgaaatcagcgagcctgaaaacgtaggcgcgccgctggtgctgattaacgaccggctcgaagacagcaacatcaaaggtttggaagaatccgagaaactgcaacaggcagaaaccgccaaaaccgaaccgaagcaggcaaaacaacgcgctgccgaaaaagtgtcggcaactgccgacagtacggatacggtagcggttgaaaaaccgaaacgcactgccgaacccaaaccgcaaaaagcggaacgcactgccgaagccaagcccaaagccaaagaaaccaaaaccgccgaaaaagttgccgacaaaccgaaaactgctgccgaaaaaaccaaaccggatacggcaaaatccgacagcgcggtaaaagaagcgaaaaaagccgacaaggctgaaggcaaaaagacagccgaaaaagaccgttcggacggcaaaaaacacgaaacggcgcaaaaaaccgacaaagcggacaaaaccaaaaccgccgagaaggaaaaatccggcaaggcgggcaaaaaagccgccattcaggcaggttatgccgaaaaagaacgcgccttgagcctccagcgcaaaatgaaggcggcgggtatcgattcgaccatcaccgaaatcatgaccgacaacggcaaagtttaccgcgtcaaatcaagcaactataaaaacgcaagggatgccgaacgcgatttgaacaaactgcgcgtgcacggcatcgccggccaggtaacgaatgaatag

SEQ ID NO: 41385 - protein, 346 aa, Neisseria gonorrhoeae
MSENKQNEVLTGYEQLKRRNRRRLVTASSLVAASCILLAAALSSDPADSNPAPQAGETGATESQTANTAQTPALKSAAENGETAADKPQDLAGEDKPSAADSEISEPENVGAPLVLINDRLEDSNIKGLEESEKLQQAETAKTEPKQAKQRAAEKVSATADSTDTVAVEKPKRTAEPKPQKAERTAEAKPKAKETKTAEKVADKPKTAAEKTKPDTAKSDSAVKEAKKADKAEGKKTAEKDRSDGKKHETAQKTDKADKTKTAEKEKSGKAGKKAAIQAGYAEKERALSLQRKMKAAGIDSTITEIMTDNGKVYRVKSSNYKNARDAERDLNKLRVHGIAGQVTNE

SEQ ID NO: 41386 - DNA, 999 bp, Neisseria meningitidis
atgtccgaaaacaaacaaaacgaagtcctgagcggttacgaacaactcaaacggcgcaaccgccgccgcctcgtaacggcaagttgcctggttgccgcctcctgcatcctgctggcagccgccctcagttccggccctgccgaacagactgccggcgaaacaagcggcgtagaaaacaaagcggcaggtgcggcacaaacccctgccttgaaatccgccgccgacaaaccgcaggacttggcaggcgaagacaagccttctgccgccgacagcgaaatcagcgagcctgaaaacgtaggcgcgccgctggtgctgattaacgagcgcctcgaagacagcaacatcaaaggtttggaagcatccgagaaactgcaacaggcagaaaccgccaaaaccgcaccgaagcaggcaaaacaacgcgctgccgaaaaagtgccggcaactgccgacagtacggatacggtagcggttgaaaaaccgaaacgcactgccgaaacaaaaccgcaaaaagcggaacgcactgccaaagccaagcccaaagccaaagaaaccaaaaccgccgaaaaagttgccgacaaaccgaaaactgccgccgaaaaaaccaaaccggatacggcaaaatccgacagcgcggtaaaagaagcgaaaaaagccgacaaggctgaaagcaaaaaaacagccgaaaaagaccgttcggacggcaaaaaacacgaaacggcacaaaaaaccgacaaagcggacaagaccaaaaccgccgagaaggaaaaatccggtaaaaaagccgccattcaggcaggttatgccgaaaaagaacgcgccttaagcctccagcgcaaaatgaaggcggcgggtatcgattcgaccatcaccgaaattatgaccgacaacggcaaagtttaccgcgtcaaatcaagcaactataaaaacgcaagggatgccgaacgcgatttgaacaaattgcgcgtacacggtatcgccggtcaggtaacgaatgaatag

SEQ ID NO: 41387 - protein, 332 aa, Neisseria meningitidis
MSENKQNEVLSGYEQLKRRNRRRLVTASCLVAASCILLAAALSSGPAEQTAGETSGVENKAAGAAQTPALKSAADKPQDLAGEDKPSAADSEISEPENVGAPLVLINERLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAAIQAGYAEKERALSLQRKMKAAGIDSTITEIMTDNGKVYRVKSSNYKNARDAERDLNKLRVHGIAGQVTNE

SEQ ID NO: 41388 - DNA, 999 bp, Neisseria meningitidis
atgtccgaaaacaaacaaaacgaagtcctgagcggttacgaacaactcaaacggcgcaaccgccgccgcctcgtaacggcaagttgcctggttgccgcctcctgcatcctgctggcagccgccctcagttccggccctgccgaacagactgccggcgaaacaagcggcgtagaaaacaaagcggcaggtgcggcacaaacccctgccttgaaatccgccgccgacaaaccgcaggacttggcaggcgaagacaagccttctgccgccgacagcgaaatcagcgagcctgaaaacgtaggcgcgccgctggtgctgattaacgaccgcctcgaagacagcaacatcaaaggtttggaagcatccgagaaactgcaacaggcagaaaccgccaaaaccgcaccgaagcaggcaaaacaacgcgctgccgaaaaagtgccggcaactgccgacagtacggatacggtagcggttgaaaaaccgaaacgcactgccgaaacaaaaccgcaaaaagcggaacgcactgccaaagccaagcccaaagccaaagaaaccaaaaccgccgaaaaagttgccgacaaaccgaaaactgccgccgaaaaaaccaaaccggatacggcaaaatccgacagcgcggtaaaagaagcgaaaaaagccgacaaggctgaaagcaaaaaaacagccgaaaaagaccgttcggacggcaaaaaacacgaaacggcacaaaaaaccgacaaagcggacaagaccaaaaccgccgagaaggaaaaatccggtaaaaaagccgccattcaggcaggttatgccgaaaaagaacgcgccttaagcctccagcgcaaaatgaaggcggcgggtatcgattcgaccatcaccgaaattatgaccgacaacggcaaagtttaccgcgtcaaatcaagcaactataaaaacgcaagggatgccgaacgcgatttgaacaaattgcgcgtacacggtatcgccggtcaggtaacgaatgaataa

SEQ ID NO: 41389 - protein, 332 aa, Neisseria meningitidis
MSENKQNEVLSGYEQLKRRNRRRLVTASCLVAASCILLAAALSSGPAEQTAGETSGVENKAAGAAQTPALKSAADKPQDLAGEDKPSAADSEISEPENVGAPLVLINDRLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAAIQAGYAEKERALSLQRKMKAAGIDSTITEIMTDNGKVYRVKSSNYKNARDAERDLNKLRVHGIAGQVTNE

SEQ ID NO: 41390 - DNA, 309 bp, Neisseria meningitidis
ctgaccccttgggcggatgcatatgcagatttgcgcggcaaaaccaaagtgatgacgacccagatgggtgcttcccgcgatgtcagcaaaagcgccaaaggttggagtgtcggtatcggtctgaatgtaggcaaacagttgaccgacagcgtcggtctcgagtttgatccatactaccgtcacaaaacaatctacaaaccccgtgagattgtcttggacggtgacaaaaccaaaatgggccgctccaaatccaacgagtacggcttccgcgtagccgcaacgttctatagtcaattaaaatcaaaatag

SEQ ID NO: 41391 - protein, 102 aa, Neisseria meningitidis
LTPWADAYADLRGKTKVMTTQMGASRDVSKSAKGWSVGIGLNVGKQLTDSVGLEFDPYYRHKTIYKPREIVLDGDKTKMGRSKSNEYGFRVAATFYSQLKSK

SEQ ID NO: 41392 - DNA, 309 bp, Neisseria meningitidis
ctaaccccttgggcggatgcatatgcagatttgcgcggcaaaaccaaagtgatgacgacccagatgtgtgcttcccgcgatgtcagcaaaagcgccaaaggttggagtgtcggtatcggtctgaatgtaggcaaacagttgaccgacagcgtcggtctcgagtttgatccatactaccgtcacaaaacaatctgcaaaccccgtgagattgttttggacggcgacaaaaccaaaatgggccgctccaaatccaacgagtacggcttccgcgtaaccgcaacgttctatagtcaattaaaatcaaagtag

SEQ ID NO: 41393 - protein, 102 aa, Neisseria meningitidis
LTPWADAYADLRGKTKVMTTQMCASRDVSKSAKGWSVGIGLNVGKQLTDSVGLEFDPYYRHKTICKPREIVLDGDKTKMGRSKSNEYGFRVTATFYSQLKSK

SEQ ID NO: 41394 - DNA, 1266 bp, Neisseria gonorrhoeae
atgagtcaaaaccaacccgcacaaccgaccaaacgcaatctgttcaaaaccgcccttgccgtcggcgcaatcggcgcaatcggaggttatttcggcggcaaaaaacagggcgaaaccgccgaacgcaccgccgaaagccaacactcgccccaagcctatccctgctacggcgaacatcaggcaggtatcgttacgccgcggcaggcgttttccattatgtgcgccttcgacgtaaccgcgcaaagtgccaagcagctggaaaacctgttccgcacactgaccgcccgcatcgagtttctcacccaaggcggagaataccaagacggcgacgacaaactcccgtcagccggcagcggcattttgggtaaagccttcaaccccgacggattgaccgttaccgtgggggtgggcagcagcctgtttgacggccggttcggactcaaagacaaaaaaacggttcatttgcaggaaatgcgcgacttccccaacgataagctgcaaaaaagctggtgcgacggcgatttgagcctgcaaatctgcgccttcacccccgaaacctgccaaaccgccctgcgcgacatcatcaaacacaccgcccaaaccgccgtcatccgctggagtatcgacgggtggcagcctaaatccgaacccggcgcgatggcggcgcgcaacctgttgggcttccgagacggcacgggcaaccccaaggtttccgatcccaaaaccgccgacgaggttttatggacgggcgtggccgccaacagcctcgacgaaccggagtgggcgaaaaacggcagctatcaggcagtccgccttatccgccgctttgtcgagttttgggacaggacgccgcttcaagagcaaaccgacattttcgggcggcgaaaatacagcggggcgccgatggacggcaaaaaagaagccgaccaaccggatttcgccaaagaccccgagggtgatatcacgcccaaagacagccatatgcgcctggcgaatccgcgcgatcccgaattcctcaaaaaacactgcctcttccgccgcgcctacagctattctcgcggacccgcctcaagcggacagcttgatgtcgggctggtgttcgtctgctatcaggcaaatcttgccgacggtttcatcttcgtgcaaaacctcctcaacggcgaaccgctggaagaatacatcagccccttcggcggcggctatttcttcgtcttgcccggcgtgggaaaaggcggattcttgggacaagggctgccgggcgtataa

SEQ ID NO: 41395 - protein, 421 aa, Neisseria gonorrhoeae
MSQNQPAQPTKRNLFKTALAVGAIGAIGGYFGGKKQGETAERTAESQHSPQAYPCYGEHQAGIVTPRQAFSIMCAFDVTAQSAKQLENLFRTLTARIEFLTQGGEYQDGDDKLPSAGSGILGKAFNPDGLTVTVGVGSSLFDGRFGLKDKKTVHLQEMRDFPNDKLQKSWCDGDLSLQICAFTPETCQTALRDIIKHTAQTAVIRWSIDGWQPKSEPGAMAARNLLGFRDGTGNPKVSDPKTADEVLWTGVAANSLDEPEWAKNGSYQAVRLIRRFVEFWDRTPLQEQTDIFGRRKYSGAPMDGKKEADQPDFAKDPEGDITPKDSHMRLANPRDPEFLKKHCLFRRAYSYSRGPASSGQLDVGLVFVCYQANLADGFIFVQNLLNGEPLEEYISPFGGGYFFVLPGVGKGGFLGQGLPGV

SEQ ID NO: 41396 - DNA, 1266 bp, Neisseria meningitidis
atgagcaaaaaacaacccgcacaaccgaccaggcgcactctttttaaaaccgcgatcgcagccggagcagtcggcgcaatcggaggttatctcggcggcaaaaaacagggcgaaaccgccgaacgcaccgccgaaagccaacactcgccccaagcctatccctgctacggcgaacatcaggcaggcatcgttacgccgcagcaggcgttttcgattatgtgcgccttcgacgtaaccgcgcaaagtgccaagcagctggaaaacctgttccgcacgctgaccgcccgcatcgagtttctcacccaaggcggcgaataccaagacggcgacgacaaacttccgccagccggcagcggcattttgggcaaagccttcaaccccgacgggttgaccgttaccgtgggggtgggcagcagcctgtttgacggccggttcggactcaaagacaaaaaaccgattcatttgcaggaaatgcgcgacttctccaacgataagctgcaaaaaagctggtgcgacggcgatttgagcctgcaaatctgtgccttcacccccgaaacctgccaagccgccctgcgcgacatcatcaaacacaccgtccaaaccgccgttatccgttggagtatcgacgggtggcagcccaaatccgaacccggcgcgatggcggcgcgcaacctgttgggcttcagggacggcacgggcaaccccaaagtttccgatcccaaaactgccgacgaggttttgtggacgggggtggccgccaacagcctcgacgaaccggagtgggcgaaaaacggcagctatcaggcagtccgccttatccgccactttgtcgagttttgggacaggacgccgcttcaagagcaaaccgacattttcgggcggcgcaaatacagcggtgcgccgatggacggcaaaaaagaagccgaccaaccggattttgccaaagaccccgagggtgatatcacgcccaaagacagccatatacgcctggcgaatccgcgcgatcccgaattcctcaaaaaacaccgcctcttccgccgcgcctacagctattcgcgcggactcgcctcaagcggacagcttgatgtcgggctggtgttcgtctgctatcaggcaaaccttgccgacggattcatcttcgtgcaaaacctcctcaacggcgaaccgctggaagaatacatcagccccttcggcggcggctatttcttcgtcttgcccggcgtggaaaaaggcggctttttggggcaagggctgctgggcgtataa

SEQ ID NO: 41397 - protein, 421 aa, Neisseria meningitidis
MSKKQPAQPTRRTLFKTAIAAGAVGAIGGYLGGKKQGETAERTAESQHSPQAYPCYGEHQAGIVTPQQAFSIMCAFDVTAQSAKQLENLFRTLTARIEFLTQGGEYQDGDDKLPPAGSGILGKAFNPDGLTVTVGVGSSLFDGRFGLKDKKPIHLQEMRDFSNDKLQKSWCDGDLSLQICAFTPETCQAALRDIIKHTVQTAVIRWSIDGWQPKSEPGAMAARNLLGFRDGTGNPKVSDPKTADEVLWTGVAANSLDEPEWAKNGSYQAVRLIRHFVEFWDRTPLQEQTDIFGRRKYSGAPMDGKKEADQPDFAKDPEGDITPKDSHIRLANPRDPEFLKKHRLFRRAYSYSRGLASSGQLDVGLVFVCYQANLADGFIFVQNLLNGEPLEEYISPFGGGYFFVLPGVEKGGFLGQGLLGV

SEQ ID NO: 41398 - DNA, 1266 bp, Neisseria meningitidis
atgagcaaaaaccaacccgcacaaccgaccaggcgcactctttttaaaaccgcgatcgcagctggagcagtcggcgcaatcggaggttatctcggcggcaaaaaacggggcgaaaccgccgaacgcaccgccgaaagccaacactcgccccaagcctatccctgctacggcgaacatcaggcaggcatcgttacgccgcagcaggcgttttcgattatgtgcgccttcgacgtaaccgcgcaaagtgccaagcagctggaaaacctgttccgcacgctgaccgcccgcatcgagtttctcacccaaggcggcgaataccaagacggcgacgacaaacttccgccagccggcagcggcattttgggcaaagccttcaaccccgacgggttgaccgttaccgtgggggtgggcagcagcctgtttgacggccggttcggactcaaagacaaaaaaccgattcatttgcaggaaatgcgcgacttctccaacgataagctgcaaaaaagctggtgcgacggcgatttgagcctgcaaatctgtgccttcacccccgaaacctgccaagccgccctgcgcgacatcatcaaacacaccgtccaaaccgccgttatccgctggagtatcgacgggtggcagcctaaatccgaacccggcgcgatggcggcgcgcaacctgttgggcttccgcgacggcacgggcaaccccaaagtttccgaccccaaaactgccgacgaggttttgtggacgggggtggccgccaacagcctcgacgaaccggagtgggcgaaaaacggcagctatcaggcagtccgccttatccgccactttgttgagttttgggacaggacgccgcttcaagagcaaaccgacattttcgggcggcgcaaatacagcggcgcgccgatggacggcaaaaaagaagccgaccaaccggattttgccaaagaccccgaggggaataccacgcccaaagacagccatatacgcctggcgaatccgcgcgatcccgagttccttaaaaaacaccgcctcttccgccgcgcctacagctattcgcgcggactcgcctcaagcggacagcttgatgtcgggctggtgttcgtctgctatcaggcaaaccttgccgacggattcatcttcgtgcaaaacctcctcaacggcgaaccgctggaagaatacatcagccccttcggcggcggctatttcttcgtcttgcccggcgtggaaaaaggcggctttttggggcaagggctgctgggcgtataa

SEQ ID NO: 41399 - protein, 421 aa, Neisseria meningitidis
MSKNQPAQPTRRTLFKTAIAAGAVGAIGGYLGGKKRGETAERTAESQHSPQAYPCYGEHQAGIVTPQQAFSIMCAFDVTAQSAKQLENLFRTLTARIEFLTQGGEYQDGDDKLPPAGSGILGKAFNPDGLTVTVGVGSSLFDGRFGLKDKKPIHLQEMRDFSNDKLQKSWCDGDLSLQICAFTPETCQAALRDIIKHTVQTAVIRWSIDGWQPKSEPGAMAARNLLGFRDGTGNPKVSDPKTADEVLWTGVAANSLDEPEWAKNGSYQAVRLIRHFVEFWDRTPLQEQTDIFGRRKYSGAPMDGKKEADQPDFAKDPEGNTTPKDSHIRLANPRDPEFLKKHRLFRRAYSYSRGLASSGQLDVGLVFVCYQANLADGFIFVQNLLNGEPLEEYISPFGGGYFFVLPGVEKGGFLGQGLLGV

SEQ ID NO: 41400 - DNA, 1167 bp, Neisseria gonorrhoeae
atgagaaaattcaatttgaccgcattgtccgtgatgcttgccttgggtttgaccgcgtgccagccgccggaggcggagaaagccgcgccggccgcgtccggtgagacccaatccgccaacgaaggcggttcggtcggtatcgccgtcaacgacaatgcctgcgaaccgatgaatctgaccgtgccgagcggacaggttgtgttcaatattaaaaacaacagcggccgcaagctcgaatgggaaatcctgaagggcgtgatggtggtggacgaacgcgaaaatatcgccccggggctttccgacaaaatgaccgtaaccctgctgccgggcgaatacgaaatgacctgcggccttttgaccaatccgcgcggcaagctggtggtagccgacagcggctttaaagacaccgccaacgaagcggatttggaaaaactgccccaaccgctcgccgactataaagcctacgttcaaggcgaggttaaagagctggcggcgaaaaccaaaacctttaccgaagccgtcaaagcaggcgacattgaaaaggcgaaatccctgtttgccgccacccgcgtccattacgaacgcatcgaaccgattgccgagcttttcagcgaactcgaccccgtcatcgatgcgtgtgaagacgacttcaaagacggtgcgaaagatgccgggtttaccggcttccaccgtatcgaacacgccctttgggtggaaaaagacgtatccggcgtgaaggaaaccgcggccaaactgatgaccgatgtcgaagccctgcaaaaagaaatcgacgcattggcgttccctccgggcaaagtggtcggcggcgcgtccgaactgattgaagaagcggcgggcagtaaaatcagcggcgaagaagaccgttacagccacaccgatttgagcgacttccaagctaatgcggacggatctaaaaaaatcgtcgatttgttccgtccgttgattgaggccaaaaacaaagccttgttggaaaaaaccgataccaacttcaaacaggtcaacgaaattctggcgaaataccgcaccaaagacggttttgaaacctacgacaagctgagcgaagccgaccgcaaagcattacaggctcctattaacgcgcttgccgaagaccttgcccaacttcgcggcatactcggcttgaaataa

SEQ ID NO: 41401 - protein, 388 aa, Neisseria gonorrhoeae; identical to SEQ ID NO: 36061

SEQ ID NO: 41402 - DNA, 1167 bp, Neisseria meningitidis; identical to SEQ ID NO: 40700

SEQ ID NO: 41403 - protein, 388 aa, Neisseria meningitidis; identical to SEQ ID NO: 40701

SEQ ID NO: 41404 - DNA, 1167 bp, Neisseria meningitidis; identical to SEQ ID NO: 40702

SEQ ID NO: 41405 - protein, 388 aa, Neisseria meningitidis; identical to SEQ ID NO: 24263

SEQ ID NO: 41406 - DNA, 972 bp, Neisseria gonorrhoeae
gtgaaaccgcgtttttattgggcagcctgcgccgtcctgccggccgcctgttcgcccgaacctgccgccgaaaaaactgtatccgccgcatcccaagccgcatccacacctgtcgccacgctgaccgtgccgaccgcgcggggcgatgccgttgtgccgaagaatcccgaacgcgtcgccgtgtacgactgggcggcgttggatacgctgaccgagccgggcgtgaatgtgggcgcaaccaccgcgccggtgcgcgtggactatttgcagcctgcatttgacaaggcggcaacggtggggacgctgtttgagcccgattgcgaatccctgcaccgccacaatccgcagtttgtcattaccggcgggccgggtgcggaagcgtatgaacagttggcgaaaaacgcgaccaccatagatttgacggtggacaacggcaatatccgcaccagcggcgagaagcagatggagaccctgtcgcggattttcggtaaggaagcgcgcgtggcggaattgaatgcgcagattgacgcgctgttcgcccaaaagcgcgaagccgccaaaggcaaaggacgcgggctggtgctgtcggttacaggcaacaaggtgtccgccttcggcacgcaatcgcggttggcaagttggatacacggcgacatcggcctgccgcccgtggacgaatctttacgcaacgaagggcacgggcagcccgtttccttcgaatacatcaaagagaaaaaccccggctggattttcatcatcgaccgcaccgccgccatcgggcaggaagggccggctgccgtggaagtgttggataacgcgctggtatgcggcacgaacgcttggaagcgcaagcaaatcatcgtcatgcctgccgcgaactacattgtcgcgggcggcgcgcggcagttgatacaggcggcggaacagttgaaggcggcgtttgaaaaggcagaacccgttgcggcgcagtag

SEQ ID NO: 41407 - protein, 323 aa, Neisseria gonorrhoeae; identical to SEQ ID NO: 36062

SEQ ID NO: 41408 - DNA, 966 bp, Neisseria meningitidis
gtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtag

SEQ ID NO: 41409 - protein, 321 aa, Neisseria meningitidis; identical to SEQ ID NO: 11426

SEQ ID NO: 41410 - DNA, 966 bp, Neisseria meningitidis
gtgaaaccgcgtttttattgggcagcctgcgccgtcctgctgaccgcctgttcgcccgaacctgccgccgaaaaaactgtatccgccgcatccgcatctgccgccacactgaccgtgccgaccgcgcggggcgatgccgttgtgccgaagaatcccgaacgcgtcgccgtgtacgactgggcggcgttggatacgctgaccgaattgggtgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttggcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggctcgcggcagttgattcaggcggcggagcagttgaaggaggcgtttgaaaaggcagaacccgttgcggcggggaaagagtag

SEQ ID NO: 41411 - protein, 321 aa, Neisseria meningitidis; identical to SEQ ID NO: 24264

SEQ ID NO: 41412 - DNA, 1014 bp, Neisseria meningitidis
atggcttggagtatgtttgccacaacccaagccgatagagcggtaaggtctgcaactgcacctaaagaaatgtggttccataagaagataatagatgaaaaaacaggtaaagtatcctttgataccagacaaatttggtcattgaatgatttaagcaaggaagaactggcaagcattcaagacacaaatggcaaagttattactgtgtctaatcctggtattttcaataatcgagaagattcattaagcaacgcagcaaaacaaaatcgtaatagtacaaacggtagtggtgttattgcagtcatgaatcctccaacagggaaatataaatctgattctaataacaaaataaaagattttttatggctcggttcaagtcttgtttctgaactgatgtatgtcggttacgaccaattaaataataaagtgttccaaggctatttacccaaaaccaattcagaaaaactgaatcaagatatttatcgagaggttcaaaaaatgggtaacggctggtcggttgataccagtaatcacagtcgtgggggaattacagcaagcgtttccttaaaagattgggtaaacaatcaaaaacaaaatggcattgccccaatcagaaaagcacgtttctatggtacagccacaaatgtgcagaatgattacgccgatgttttacagaaaaacggctatacctatacgggtgcagacggcaaaacttataacagcggatcctactcaatcgtgcatgataaagattttgtggggaacaaatggatacctttcttgctaggaaccaatgacaccacacaaggtacatgtaaggggttgtgctattcgcatagcagttattttgcggaggtgccaaaagcaggtacaaaagaatttgatgactatgtaaaaatatggggtgaagttgaatatgacgctcaaggtaagccaattaacaaatctaaacccatactggtagaaccaaacaaaacaaaagataatgaaaaatatgaaaaagaagctttctaa

SEQ ID NO: 41413 - protein, 337 aa, Neisseria meningitidis
MAWSMFATTQADRAVRSATAPKEMWFHKKIIDEKTGKVSFDTRQIWSLNDLSKEELASIQDTNGKVITVSNPGIFNNREDSLSNAAKQNRNSTNGSGVIAVMNPPTGKYKSDSNNKIKDFLWLGSSLVSELMYVGYDQLNNKVFQGYLPKTNSEKLNQDIYREVQKMGNGWSVDTSNHSRGGITASVSLKDWVNNQKQNGIAPIRKARFYGTATNVQNDYADVLQKNGYTYTGADGKTYNSGSYSIVHDKDFVGNKWIPFLLGTNDTTQGTCKGLCYSHSSYFAEVPKAGTKEFDDYVKIWGEVEYDAQGKPINKSKPILVEPNKTKDNEKYEKEAF

SEQ ID NO: 41414 - DNA, 1413 bp, Neisseria meningitidis
atgaaaatttccagacctccggaatttaccctgttgcaacaggaatatatgcagcatctcactgaaagaatgacgcaaattgccaagctgctgaattcttccgcaaacaatcctgatatagacattcccgattttcttactgaaatcaaagattattcagaattttccgtgacagatgaaaatggaacctacctgcattgggacaaattccgccggattcacacggaagatacgcggatgaaatggcgcgccgttaaggaaagccgcaaaaaaatccaaaaaccaattgatttcccgtttgaacatcagttttggttctgcattcccgactctttgcaggcacggcttcatttgattgacaaaagctgcggcagttctatcggcacgtctagcttgggtggcttcggcagaagcgagcaaaacagattcttgctcaagtctctgattatggaagaagcgattacatccgcccaactggaaggtgcggctaccacgcgtaaagtggccaaggatatgctcaaatcgcagcgtaaacccaaaacaaaagacgaaatcatgatagtgaacaactatcacttgatgaaaaaagcggtagaattgaaaaatacgccgttaagtgttgaaatgattttggatttgcaccgcattgctaccagtaacgctattgaaaacaaggccgagcccggacaattcaggcaggatgacgaaatctttatcgccgatatcaatggtaacagcctgtatcaaccaccgccgcacggacaggttcatacgctgatggaagaggtgtgtgcgtttgccaataatacctatgacggcgtggaaaatccgtttatccatccggttgtccaagctattatcttgcatttcctcatcggctacatccacccatttggtgatggcaacgggcggacagcgcgggctttgttctattggtttatgctcaaaaacggctactggctatttgaatacatatccatcagccgtcttctgaaaaacgctcctgcccaatacgccaaatcctatttgtatgcggaaactgacgatttagatttaacctatttcatctattaccaatgcgatattatcaagcgggcggttgccgatttggagcactacatttccgacaaacaaaaacaccaacaggaattcaaagcagcgattgcccaatatactgaaaagataggaaagttgaaccaacggcaaattggtatcctgcaaaaagcagtggaagaaagcggaaaaatctttactgcacaagaaattgccaaccaatacggcatctccctgaatactgcccgtagcgatttgagtaaactgggagaatatagattcctagtgccgttcaaatcaggaaatgctttagagtatgttgctcctcaggatttattggaaaggttagaaaaaaaatag

SEQ ID NO: 41415 - protein, 470 aa, Neisseria meningitidis
MKISRPPEFTLLQQEYMQHLTERMTQIAKLLNSSANNPDIDIPDFLTEIKDYSEFSVTDENGTYLHWDKFRRIHTEDTRMKWRAVKESRKKIQKPIDFPFEHQFWFCIPDSLQARLHLIDKSCGSSIGTSSLGGFGRSEQNRFLLKSLIMEEAITSAQLEGAATTRKVAKDMLKSQRKPKTKDEIMIVNNYHLMKKAVELKNTPLSVEMILDLHRIATSNAIENKAEPGQFRQDDEIFIADINGNSLYQPPPHGQVHTLMEEVCAFANNTYDGVENPFIHPVVQAIILHFLIGYIHPFGDGNGRTARALFYWFMLKNGYWLFEYISISRLLKNAPAQYAKSYLYAETDDLDLTYFIYYQCDIIKRAVADLEHYISDKQKHQQEFKAAIAQYTEKIGKLNQRQIGILQKAVEESGKIFTAQEIANQYGISLNTARSDLSKLGEYRFLVPFKSGNALEYVAPQDLLERLEKK

SEQ ID NO: 41416 - DNA, 1413 bp, Neisseria meningitidis; identical to SEQ ID NO: 41414

SEQ ID NO: 41417 - protein, 470 aa, Neisseria meningitidis; identical to SEQ ID NO: 41415

SEQ ID NO: 41418 - DNA, 459 bp, Neisseria meningitidis
atgcccatcactccacccttaaacatcatctctcctaaactctaccccaatgaacaatggaacgaaagcgaagcactcggtgccatcacttggctatggtatcagtcgcctacgcatcgccaagtacctattgtggagatgatgacgtatatattgcctgtgttaaaaaacgggcagttcgctttgttttgcaagggtacccaaccaatcggttatatctcatgggcttattttgatgaagtggcgcaggcgcattatttagaatctgaccgccatttgcgtgacaacagcgattggaactgtggcgacaatatttggctgattcaatggtttgcgccattgggacacagtcatcaaatgcgctcagctgtgcgccagttatttcctagtacgacagtacgcgccttgtatcataaagggagcgataagggtttgagaattttaacttttaaaacttga

SEQ ID NO: 41419 - protein, 152 aa, Neisseria meningitidis
MPITPPLNIISPKLYPNEQWNESEALGAITWLWYQSPTHRQVPIVEMMTYILPVLKNGQFALFCKGTQPIGYISWAYFDEVAQAHYLESDRHLRDNSDWNCGDNIWLIQWFAPLGHSHQMRSAVRQLFPSTTVRALYHKGSDKGLRILTFKT

SEQ ID NO: 41420 - DNA, 1290 bp, Neisseria meningitidis
atgatgaagtctatcctcaccgtatccggaaatcgtatgcgtaaacccagaatcacctatttggatgtttgggcaaacgatgaaagaatcggtactttggaaaagggggccatgtatcggttcgcatacgacaatcccaattcttcgttgctgggcctgcattatcaagacagaagcaaggtatatatcagcaacaatatgccgcatatctttgcacagtattttccggaaggctttttggatgcacacatcacaagcaaatatgcttttcatgatgcgccttttgaagacaatgagatgctgcgcttggcaattctgtgcagagagactttgggtcggatacatgtgcgctgtaatgacccgctttttaatgaatggattgacgggttggagatgaaaaatccaagaatattgactgaacgggatttgctgggcataaatgcccgacaggtttttcagcaatatatggcagaaatcttccatcacggccgtttcgtcagtgtatccgggatacagcagaagatgtccttagatgccatccgcagaaataccaagcaaactgcctcatatattgccaaaggttttgatgcatccgaatatccttgcttggctgccaatgaatttttatgcatgcagaccatcaaacaagccggcattgccgttgcacagaccagcctgtcggaagattcatcagtcttattggtacgtcggtttgatgtcagtgaacagggttattttttagggatggaagactttaccagtctgcgccagtattcggtagaagataaatataaaggcagttatgcggctattgcacagattatccgacagatatccggcagaccagatgaagatttaatccatttctttaatcagcttgctgccagttgcatattgaaaaacggcgatgcacacctcaaaaatttttcagtactctatcatgacgaatacgatgttcgtcttgcacctgtctatgatgtattggatacatcaatatacagggttggaacacaaggaatttttgatgcttatgacgatacgctggcattaaacctgactaaccacggtaagaaaacatatccttccaagaatacattgttggattttgctgagaaatattgcgatttgggaagagaagatgcatcctttatgatagatacaatcgttcaagctaaagaacaggttcttgttaaatactcggatgtattgcgtgagaatgaatggttggcgcagaagtggcattttatcccggatgaaaatgaagaaggtctaccgtttacattccggtag

SEQ ID NO: 41421 - protein, 429 aa, Neisseria meningitidis
MMKSILTVSGNRMRKPRITYLDVWANDERIGTLEKGAMYRFAYDNPNSSLLGLHYQDRSKVYISNNMPHIFAQYFPEGFLDAHITSKYAFHDAPFEDNEMLRLAILCRETLGRIHVRCNDPLFNEWIDGLEMKNPRILTERDLLGINARQVFQQYMAEIFHHGRFVSVSGIQQKMSLDAIRRNTKQTASYIAKGFDASEYPCLAANEFLCMQTIKQAGIAVAQTSLSEDSSVLLVRRFDVSEQGYFLGMEDFTSLRQYSVEDKYKGSYAAIAQIIRQISGRPDEDLIHFFNQLAASCILKNGDAHLKNFSVLYHDEYDVRLAPVYDVLDTSIYRVGTQGIFDAYDDTLALNLTNHGKKTYPSKNTLLDFAEKYCDLGREDASFMIDTIVQAKEQVLVKYSDVLRENEWLAQKWHFIPDENEEGLPFTFR

SEQ ID NO: 41422 - DNA, 438 bp, Neisseria meningitidis
atgagccgttacctgattacctttgatatggataccaactgcctgaaagacaattaccacggaaataactataccaatgcctactccgatattaaaaccatcttggctagacatggatttgagaacattcagggcagtgtttatctaggccgtgaaggcatcagtgaagcacacggaacaatagccattcaggaactgaccgctcggtttgattggttttactcctgtatttcaaacattaagttttaccgccttgaaagtgatttgaacgcacaatttatcgctgatggtgtgtatcaagccaaacaggctttccttcaacgtgttgaacaacttcgtatatccctaacagaagctggattgtctgatgagcaaatcaatcaggttctggaaaaacagaaatttgaattggaaagtcctaacctgaaattaaattaa

SEQ ID NO: 41423 - protein, 145 aa, Neisseria meningitidis
MSRYLITFDMDTNCLKDNYHGNNYTNAYSDIKTILARHGFENIQGSVYLGREGISEAHGTIAIQELTARFDWFYSCISNIKFYRLESDLNAQFIADGVYQAKQAFLQRVEQLRISLTEAGLSDEQINQVLEKQKFELESPNLKLN

SEQ ID NO: 41424 - DNA, 561 bp, Neisseria meningitidis
atgaccgccaactttgcacagacgctggtcgaaatacaggacagtctgtacagggttgtgtcaaccgtccaatacggggatgacaacctcaagcggttgacagcggacaaacggaagcagtatgagttgaacttcaagatttccgagggttctacgcgtgtagagtccgactttaaagagactttggttcggttcggtagagatatgcttcaagatatgccccctaaaatccgttcggcaacgctggtagcgttgacgaccctgcttgtcggaggggcgttgggttacggttatttggaatacctgaagcaggttgcttcggaagggtatcagaccgagcgtctgtataatgccgtcgaccgtcttgcagaatcccaagaacggataacgtccgccatcctgaagggtgctagaggtgccgatttcgtgcaaatcggcagacgttcctacagtagggaggatatatcggaggcaaatagacgtgcagagcgtgtcccgtatggcgcagagttggtttcagacggcaattttaccgctgttttatctgatataggggattaa

SEQ ID NO: 41425 - protein, 186 aa, Neisseria meningitidis
MTANFAQTLVEIQDSLYRVVSTVQYGDDNLKRLTADKRKQYELNFKISEGSTRVESDFKETLVRFGRDMLQDMPPKIRSATLVALTTLLVGGALGYGYLEYLKQVASEGYQTERLYNAVDRLAESQERITSAILKGARGADFVQIGRRSYSREDISEANRRAERVPYGAELVSDGNFTAVLSDIGD

SEQ ID NO: 41426 - DNA, 561 bp, Neisseria meningitidis
  misc_feature (51)..(51): n is a, c, g, or t
atgaccgccaactttgcacagacgctggtcgaaatacaggacagtctgtanagggttgtgtcaaccgtccaatacggggatgacaacctcaagcggttgacagcggacaaacggaagcagtatgagttgaacttcaagatttccgagggttctacgcgtgtagagtccgactttaaagagactttggttcggttcggtagagatatgcttcaagatatgccccctaaaatccgttcggcaacgctggtagcgttgacgaccctgcttgtcggaggggcgttgggttacggttatttggaatacctgaagcaggttgcttcggaagggtatcagaccgagcgtctgtataatgccgtcgaccgtcttgcagaatcccaagaacggataacgtccgccatcctgaagggtgctagaggtgccgatttcgtgcaaatcggcagacgttcctacagtagggaggatatatcggaggcaaatagacgtgcagagcgtgtcccgtatggcgcagagttggtttcagacggcaattttaccgctgttttatctgatataggggattaa

SEQ ID NO: 41427 - protein, 186 aa, Neisseria meningitidis; identical to SEQ ID NO: 24265
  misc_feature (17)..(17): Xaa can be any naturally occurring amino acid

SEQ ID NO: 41428 - DNA, 564 bp, Neisseria meningitidis
atgaaaatactcgctttattaattgccgctacctgtgctttatctgcgtgtggcagccaatctgaagaacaaccggcatctgcacaaccccaagagcaggcacaatccgaattaaaaaccatgccggtaagctataccgactatcaatcagcagccaataaagggctgaatgaccaaaaaaccggtctgacccttcctgaacatgttgtccctatcgacaatgcggaaggaaagaatctgctgcatgacttttcagacggcctcacaatcttaaccgttgataccgataaagccgacaaaattactgctgtccgagtagtctggaatacagatgcaatgcctcaaaaagcggaaaaactgtccaaagctgccgcagccttgattgcggcaaccgctccggaagaccgcacaatgctgcgtgataccggcgaccaaatcgaaatggcgattgacagccataatgcgcaaaaagagccaacccgagaatgggcgcgtggtgggattgcttataaagtcactgttaccaatttaccgagcgtggttttgacggcaaaagctgagtaa

SEQ ID NO: 41429 - protein, 187 aa, Neisseria meningitidis
MKILALLIAATCALSACGSQSEEQPASAQPQEQAQSELKTMPVSYTDYQSAANKGLNDQKTGLTLPEHVVPIDNAEGKNLLHDFSDGLTILTVDTDKADKITAVRVVWNTDAMPQKAEKLSKAAAALIAATAPEDRTMLRDTGDQIEMAIDSHNAQKEPTREWARGGIAYKVTVTNLPSVVLTAKAE

SEQ ID NO: 41430 - DNA, 504 bp, Neisseria meningitidis
atgaacaatctgaccgtgtttacccgtttcgataccgatttggcgacgcttgccgatgaattgcaatatgtgtgggaacacaccgccgttacagaccatcagggcaaactggtggaaattcccgtctgctacggcggcgaatacggcccggatttggcggaagtcgctgctttccatcagacggttatttccgaaatcgtccgccgccatacggcgcaaacttataccgtatttatgatgggcttccagcccggtttcccttatctgggcggcttgcccgaagcattgcacacgccccgccgtgccgtgccgagaacgtccgttcctgccggttcggtcggtatcggcggcagtcagaccggtgtgtatccgttcgcttcgcccggcggctggcagattatcggcagaaccgaattacccttgttccgagccgatttgaatccgccgaccctgctggcggcgggtgaccaagtccgctttgttgcagaaaggattgagccatga

SEQ ID NO: 41431 - protein, 167 aa, Neisseria meningitidis; identical to SEQ ID NO: 24266

SEQ ID NO: 41432 - DNA, 504 bp, Neisseria meningitidis
atgaacaatctgaccgtgttcacccgtttcgataccgatttggcgacgcttgccgatgaattgcaatatgtgtgggaacacaccgccgttacagaccatcagggcaaactggtggaaattcccgtctgctacggcggcgaatacggcccggatttggcggaagtcgctgctttccatcagacggttatttccgaaatcgtccgccgccatacggcgcaaacttataccgtatttatgatgggcttccagcctggtttcccttatctgggcggcttgcccgaagcattgcacacgccccgccgtgccgtgccgagaacgtccgttcctgccggttcggtcggtatcggcggcagtcagaccggtgtgtatccgttcgcttcgcccggcggctggcagattatcggcagaaccgaattacccttgttccgagccgatttgaatccgccgaccctgctggcggcgggtgaccaagtccgctttgttgcagaaaggattgagccatga

SEQ ID NO: 41433 - protein, 167 aa, Neisseria meningitidis; identical to SEQ ID NO: 24266

SEQ ID NO: 41434 - DNA, 4296 bp, Neisseria meningitidis
atgcgcttcacacacaccaccccattttgttccgtattgtccaccctcggtctttttgccgtttcccctgcttactcatccattgtccgcaacgatgtcgattaccaatattttcgcgactttgccgaaaataaaggcgcgttcaccgtaggtgcaagcaatatttccatccaagacaagcaaggcaaaatattaggcagggttctcaacggcatccccatgcccgacttccgcgtcagcaaccgccaaaccgccatcgccaccctggttcacccccaatacgtcaacagtgtcaaacacaacgtcggctacggttccatacaattcggcaacgacacccaaaatccagaagaacaagcctatacctaccgcctcgtatcacgcaacccgcacccggactacgactaccaccttccccgcctcaacaaactggttaccgaaatctcacctaccgcactcagcagcgtacccttgcttggaaacggccagccaaaggccaatgcctacctcgataccgaccgcttcccctactttgtacgactcggctcaggcacgcaacaagtccgcaaagcagacggcacgcgtacacgaaccgccccggcataccaatacctgaccggcggcacgccgctgaaagtattggggttccaaaaccacggcttactcgtcggcggcagcctgaccgaccaaccccttaacacctacgcaatcgccggagacagcggttcccccctgtttgccttcgacaagcatgaaaaccgctgggtgcttgcgggcgtactcagcacctacgccggcttcgataatttcttcaacaaatacatcgtcacgcaacccgaattcatccgttccaccatccgccaatacgaaacccggctggatgtcgggctgaccaccaacgaactcatatggcgcgacaacggtaatggcaacagcaccctgcaagggctcaacgaacgcatcaccctgcccattgcaaacccttcgcttgccccacaaaacgacagcaggcacatgccgtctgaagatgccggcaaaacgctcatcctatccagcaggttcgacaacaaaacactgatgctggcagacaatatcaaccaaggcgcaggcgcattgcagttcgacagcaacttcaccgtcgtcggtaaaaaccacacatggcaaggtgcaggcgttatcgtagccgacggcaaacgcgtcttctggcaagtcagcaaccccaaaggcgaccggctctccaaactgggcgcaggcacgcttatcgccaacggacaaggcatcaaccagggcgacatcagcatcggggaaggcactgtcgtactcgcccaaaaagctgcttcagacggcagcaaacaagcattcaaccaagtcggcatcaccagcggcaggggcacggccgtcctcgccgacagccagcaaatcaaacccgaaaacctctatttcggcttcaggggcggacggctcgacctcaacggcaacaaccttgcctttacccatatccgccatgcggacggcggcgcgcaaatcgtcaatcacaaccctgaccaagccgcgacactgacgctgaccggcaaccccgtcctcagtcccgagcatgtcgagtgggtgcaatggggcaaccgtccgcaaggcaacgcggcggtttacgaatacatcaacccgcaccgcaaccgtcggaccgactacttcatactcaaacccggcggcaacccgcgcgaatttttcccgttaaatatgaaaaactcaacaagctggcaatttatcggcaacaacaggcaacaggccgccgaacaagtcgcccaagccgaaaatgcccgccccgacctgattaccttcggcggatacttgggtgaaaacgcgcaaacgggcaaagccgcgccgagttacagcaaaaccaatgaagcagccatagaaaaaacccgccatatcgcaaatgccgccgtatacggccggcccgaataccgttacaacggcgcactcaacctgcactatcgtcccaaacgcaccgacagcacgctgttgctcaacggcggcatgaaccttaacggggaagtcttgattgagggcggcaatatgattgtgtcaggcaggcccgtaccccatgcctacgaccaccaggccaaacgcgaacccgttcttgaaaacgaatggaccgacggcagcttcaaggctgcacggttcaccctgcgaaaccatgcccgactgacggcagggcgcaataccgcgcatctggacggcgacataaccgcatacgatctgtccggcatcgacctcggctttacccaaggcaaaacaccggaatgctaccgctcctaccatagcggcagcacccactgcacacccaacgccgttttaaaagccgaaaactatcgtgcactacctgcaacgcaagtacgcggcgacattacccttaacgaccgttcagagctccgcctgggcaaagcacacctgtacggcagcatccgtgccggcaaagacaccgcagtccgcatggaagcagacagcaactggacactttcccagtccagccacaccggcgcactgacgcttgacggcgcacaaattaccctgaaccccgatttcgccaataatacacacaacaaccgcttcaacacactgaccgtcaacggcacacttgacgggttcggcacattccgattcctgaccggcatcgtccgaaaacaaaatgccccccccctcaaactggaaggggacagccgcggcgcattccaaatccacgtcaaaaacaccggacaagaacctcaaacaaccgaatcgcttgcacttgtgagcctcaatccgaaacacagccaccaagcccgattcaccctccaaaacggctatgccgatttgggtgcctaccgctacatcctccgcaaaaacaacaacggatacagcctgtacaacccgctcaaagaggccgaacttcaaattgaagccacgcgtgcggaacatgagcgcaaccaacaggcatacaaccaattacaggcaaccgacatcagcagacaggttcaacatgactctgacgcgaccaggcaggcactacaggcctggcagaacagtcaaaccgaacttgcccgcatcgacagccaagtccaatatctgtccgcccaattgaaacagacagacccgctgaccggcattctgacgcgtgcccaaaacctgtgtgccgcacaaggatacagtgccgatatctgccgtcaggttgccaaagccgccgacacgaacgacctgacactcttcgaaaccgaactggatacgtatatagaacgtgtagaaatggccgaatccgaacttgacaaagcacggcaaggcggcgatgcgcaagccgtcgaaacagcccggcacgcctacctgaacgcactcaaccgtctgtcccgacaaatccacagtttgaaaaccggcgttgccggcatccgtatgccgaacctggccgaactgatcagccggtcggccaacaccgccgtttccgaacaggccgcctacaataccggccggcaacaggcgggacgccgcatcgaccgccaccttaccgatccgcagcagcaaaacatctggctggaaaccggtacgcaacaaaccgactaccatagcggcacacaccgtccctaccaacaaactaccaactatgcacatatcggcatccaaaccggcatcaccgaccgtctcagtgtcggtacgattttaaccgatgagcgcacaaacaaccgttttgatgaaggcgtatccgcccgaaaccgcagcaacggcgcacatctgttcgtcaaaggggaaaacggcgcactctttgccgcggcagatttaggctacagcaacagccgtacccgatttaccgattatgacggggctgccgtccgccgccacgcatgggatgcaggcatcaacaccggcatcaaaatcgataccggcatcaacctcagaccctatgccggcatccgtataaaccgcagcaacggcaaccggtacgtactcgacggcgcagagataaacagcccggcgcaaatccaaaccacatggcatgccggcatccgtctcgataaaaccgtcgaactgggtcaagccaagctgacccccgccttcagcagcgattactaccatacccgccaaaacagcggttccgccctcagcgtcaacgaccgtaccttactgcagcaagccgcccacggcacactgcataccctgcaaatcgacgccggatacaaaggctggaacgccaaacttcatgccgcttacggcaaagacagcaacaccgcccgccacaaacaggcaggaatcaaaataggctacaactggtaa

SEQ ID NO: 41435 - protein, 1431 aa, Neisseria meningitidis
MRFTHTTPFCSVLSTLGLFAVSPAYSSIVRNDVDYQYFRDFAENKGAFTVGASNISIQDKQGKILGRVLNGIPMPDFRVSNRQTAIATLVHPQYVNSVKHNVGYGSIQFGNDTQNPEEQAYTYRLVSRNPHPDYDYHLPRLNKLVTEISPTALSSVPLLGNGQPKANAYLDTDRFPYFVRLGSGTQQVRKADGTRTRTAPAYQYLTGGTPLKVLGFQNHGLLVGGSLTDQPLNTYAIAGDSGSPLFAFDKHENRWVLAGVLSTYAGFDNFFNKYIVTQPEFIRSTIRQYETRLDVGLTTNELIWRDNGNGNSTLQGLNERITLPIANPSLAPQNDSRHMPSEDAGKTLILSSRFDNKTLMLADNINQGAGALQFDSNFTVVGKNHTWQGAGVIVADGKRVFWQVSNPKGDRLSKLGAGTLIANGQGINQGDISIGEGTVVLAQKAASDGSKQAFNQVGITSGRGTAVLADSQQIKPENLYFGFRGGRLDLNGNNLAFTHIRHADGGAQIVNHNPDQAATLTLTGNPVLSPEHVEWVQWGNRPQGNAAVYEYINPHRNRRTDYFILKPGGNPREFFPLNMKNSTSWQFIGNNRQQAAEQVAQAENARPDLITFGGYLGENAQTGKAAPSYSKTNEAAIEKTRHIANAAVYGRPEYRYNGALNLHYRPKRTDSTLLLNGGMNLNGEVLIEGGNMIVSGRPVPHAYDHQAKREPVLENEWTDGSFKAARFTLRNHARLTAGRNTAHLDGDITAYDLSGIDLGFTQGKTPECYRSYHSGSTHCTPNAVLKAENYRALPATQVRGDITLNDRSELRLGKAHLYGSIRAGKDTAVRMEADSNWTLSQSSHTGALTLDGAQITLNPDFANNTHNNRFNTLTVNGTLDGFGTFRFLTGIVRKQNAPPLKLEGDSRGAFQIHVKNTGQEPQTTESLALVSLNPKHSHQARFTLQNGYADLGAYRYILRKNNNGYSLYNPLKEAELQIEATRAEHERNQQAYNQLQATDISRQVQHDSDATRQALQAWQNSQTELARIDSQVQYLSAQLKQTDPLTGILTRAQNLCAAQGYSADICRQVAKAADTNDLTLFETELDTYIERVEMAESELDKARQGGDAQAVETARHAYLNALNRLSRQIHSLKTGVAGIRMPNLAELISRSANTAVSEQAAYNTGRQQAGRRIDRHLTDPQQQNIWLETGTQQTDYHSGTHRPYQQTTNYAHIGIQTGITDRLSVGTILTDERTNNRFDEGVSARNRSNGAHLFVKGENGALFAAADLGYSNSRTRFTDYDGAAVRRHAWDAGINTGIKIDTGINLRPYAGIRINRSNGNRYVLDGAEINSPAQIQTTWHAGIRLDKTVELGQAKLTPAFSSDYYHTRQNSGSALSVNDRTLLQQAAHGTLHTLQIDAGYKGWNAKLHAAYGKDSNTARHKQAGIKIGYNW

SEQ ID NO: 41436 - DNA, 465 bp, Neisseria gonorrhoeae
aacaaccgcaacacccgttacgccgcattgggcaaacgcgtgatggaaggcgttgagaccgaaatcagcggtgcgattacaccgaaatggcaaatccatgcaggttacagctatctgcacagccaaatcaaaaccgccgccaatccacgcgacgacggcatcttcctgctggtgcccaaacacagcgcaaacctgtggacgacttaccaagttacgcccgggctgaccgtcggcggcggcgtgaacgcgatgagcggcattacttcatctgcagggatgcatgcaggcggttatgccacgttcgatgcgatggcggcataccgcttcacgcccaagctgaagctgcaaatcaatgccgacaacatcttcaaccgccattactacgcccgcgtcggcggcacgaacacctttaacattcccggttcggagcgcagcctgacggcaaacctgcgttacagtttttaa

SEQ ID NO: 41437 - protein, 154 aa, Neisseria gonorrhoeae; identical to SEQ ID NO: 36063

SEQ ID NO: 41438 - DNA, 2127 bp, Neisseria meningitidis
atgggacagtttatgtcagttttccgcatcaatatgaccgccgccacggttttggcagcactctcgtcttcggtttttgccgcacaaacggaaggtttggaaaccgtccatattaagggtcagcgttcttacaacgcgattgccaccgagaaaaacggcgattacagctcgtttgccgccaccgtcggtacaaaaatccccgcttctttgcgcgaaattccgcaatccgtcagcatcattaccaaccagcaggtcaaagaccgcaatgttgatacgtttgaccagttggcacgcaaaacgcccggcctgcgcgtgttgagcaacgacgacggacgctcttcggtttacgcgcgcggttacgaatacagcgaatacaacatcgacggcctgcccgcgcagatgcagagtatcaacggcacgctgcccaacctgttcgccttcgaccgcgtggaagtgatgcgcgggccgagcggactgttcgacagcagcggcgagatgggcggcatcgtgaatctggtgcgcaaacgcccgaccaaagcgttccaaggtcatgcggcggcagggttcggtacgcacaaacaatataaagccgaggcggacgtatcgggcagcctcaattcagacggcagcgtgcgcggccgcgtgatggcgcagaccgtcggcgcgtctccgcgtcccgccgagaaaaacaaccggcgcgaaaccttctacgcggcggcggattgggacatcaaccccgatacggttttgggcgcgggctatctttaccagcaacgccgcctcgcgccgtacaacggcctgcctgccgatgccaataacaaattaccgtccctgccgcaacacgtatttgtcggcgcggattggaacaaatttaaaatgcacagccacgacgtgttcgccgatttgaaacattacttcggcaacggcggctacggcaaagtcggtatgcgctattccgatcggaaagccgattccaattatacgtttgcgggcagcaaactcaacaataccggacaagccgacgtagcgggtttgggtacggacattaaacaaaaagcctttgcggttgacgcaagttacagccgtccgtttgccttgggcaacaccgccaacgaatttgtgattggtgcagactacaaccgcttgcgcagtactaatgaacaagggcgttcgactttgtcaaaaagcgtcgctttagatggtttccgcgctttgccttataacggcatacttcagaacgcccgcgccggaaacaaaggtttcaatcactccgttaccgaagaaaacctcgacgaaaccggtttgtatgccaagacggtgttccgtcctctggaaggtttgtcgttgattgcaggcggacgtgtaggacatcacaaaatcgagtcgggcgacggcaaaaccctgcataaagcttcgaaaaccaaatttacaagctacgccggcgcggtttacgatatagacggcagcaacagcctgtacgcttccgcctcccaactctacacaccgcaaaccagcatcggcaccgacggcaagctgctcaaaccgcgcgaaggcaaccagtttgaaatcggctacaaaggcagctacatggacgaccgcctcaatacccgggtttcgttctaccgcatgaaggataaaaacgccgccgcaccgctggactcaaacaacaaaaaaacccgttacgccgcattgggcaaacgcgtgatggaaggtgttgagaccgaaatcagcggcgcgatgacaccgaaatggcaaatccatgcaggttacagctacctgcacagccaaatcaaaaccgcctccaattcgcgcgacgaaggcatcttcctgctgatgcccaaacacagcgcaaacctgtggacgacttaccaagttacgtccgggctgaccatcggcggcggcgtgaacgcgatgagcggcattacttcatctgcagggatacatgcaggcggttatgccacgttcgatgcgatggcggcataccgcttcacgcccaaactgaagctgcaaatcaacgccgacaacatcttcaaccgccattactacgcccgcgtcggcagcgagagcacctttaacattcccggttcggagcgcagcctgacggcaaacctgcgttacagtttttaa

SEQ ID NO: 41439 - protein, 708 aa, Neisseria meningitidis
MGQFMSVFRINMTAATVLAALSSSVFAAQTEGLETVHIKGQRSYNAIATEKNGDYSSFAATVGTKIPASLREIPQSVSIITNQQVKDRNVDTFDQLARKTPGLRVLSNDDGRSSVYARGYEYSEYNIDGLPAQMQSINGTLPNLFAFDRVEVMRGPSGLFDSSGEMGGIVNLVRKRPTKAFQGHAAAGFGTHKQYKAEADVSGSLNSDGSVRGRVMAQTVGASPRPAEKNNRRETFYAAADWDINPDTVLGAGYLYQQRRLAPYNGLPADANNKLPSLPQHVFVGADWNKFKMHSHDVFADLKHYFGNGGYGKVGMRYSDRKADSNYTFAGSKLNNTGQADVAGLGTDIKQKAFAVDASYSRPFALGNTANEFVIGADYNRLRSTNEQGRSTLSKSVALDGFRALPYNGILQNARAGNKGFNHSVTEENLDETGLYAKTVFRPLEGLSLIAGGRVGHHKIESGDGKTLHKASKTKFTSYAGAVYDIDGSNSLYASASQLYTPQTSIGTDGKLLKPREGNQFEIGYKGSYMDDRLNTRVSFYRMKDKNAAAPLDSNNKKTRYAALGKRVMEGVETEISGAMTPKWQIHAGYSYLHSQIKTASNSRDEGIFLLMPKHSANLWTTYQVTSGLTIGGGVNAMSGITSSAGIHAGGYATFDAMAAYRFTPKLKLQINADNIFNRHYYARVGSESTFNIPGSERSLTANLRYSF

SEQ ID NO: 41440 - DNA, 2112 bp, Neisseria meningitidis
atgaaaatatcatttcatttagctttattacccacgctgattattgcttccttccctgttgctgccgccgatacgcaggacaatggtgaacattacaccgccactctgcccaccgtttccgtggtcggacagtccgacaccagcgtactcaaaggctacatcaactacgacgaagccgccgttacccgcaacggacagctcatcaaagaaacgccgcaaaccatcgatacgctcaatatccagaaaaacaaaaattacggtacgaacgatttgagttccatcctcgaaggcaatgccggcatcgacgctgcctacgatatgcgcggtgaaagcattttcctgcgcggttttcaagccgacgcatccgatatttaccgcgacggcgtgcgcgaaagcggacaagtgcgccgcagtactgccaacatcgagcgcgtggaaatcctgaaaggcccgtcttccgtgctttacggccgcaccaacggcggcggcgtcatcaacatggtcagcaaatacgccaacttcaaacaaagccgcaacatcggagcggtttacggctcatgggcaaaccgcagcctgaatatggacattaacgaagtgctgaacaaaaacgtcgccatccgtctcaccggcgaagtcgggcgcgccaattcgttccgcagcggcatagacagcaaaaatgtcatggtttcgcccagcattaccgtcaaactcgacaacggcttgaagtggacggggcaatacacctacgacaatgtggagcgcacgcccgaccgcagtccgaccaagtccgtgtacgaccgcttcggactgccttaccgcatggggttcgcccaccggaacgattttgtcaaagacaagctgcaagtttggcgttccgaccttgaatacgccttcaacgacaaatggcgtgcccaatggcagctcgcccaccgcacggcggcgcaggattttgatcatttctatgcaggcagcgaaaatggcaacttaatcaaacgtaactacgcctggcagcagaccgacaacaaaaccctgtcgtccaacttaacgctcaacggcgactacaccatcggccgttttgaaaaccacctgaccgtaggcatggattacagccgcgaacaccgcaacccgacattgggtttcagcagcgccttttccgcctccatcaacccctacgaccgcgcaagctggccggcttcgggcagattgcagcctattctgacccaaaaccgccacaaagccgactcctacggcatctttgtgcaaaacatcttctccgccacgcccgatttgaaattcgtcctcggcggccgttacgacaaatacacctttaattccgaaaacaaactcaccggcagcagccgccaatacagcggacactcgttcagccccaacatcggcgcagtgtggaacatcaatcccgtccacacactttacgcctcgtataacaaaggcttcgcgccttatggcggacgcggcggctatttgagcatcgatacgttgtcttccgccgtgttcaacgccgaccccgagtacacccgccaatacgaaaccggcgtgaaaagcagttggctggacgaccgcctcagcactacgttgtctgcctaccaaatcgaacgcttcaatatccgctaccgccccgatccaaaaaacaacccttatatttatgcggttagcggcaaacaccgttcgcgcggcgtggaattgtccgccatcgggcaaatcatccccaaaaaactctatctgcgcggttcgttgggcgtgatgcaggcgaaagtcgttgaagacaaagaaaatcccgaccgagtgggcatccatttgaataataccagcaacgttaccggcaacctgtttttccgttataccccgaccgaaaacctctacggcgaaatcggcgtaaccggtacaggcaaacgctacggttacaactcaagaaataaagaagtgactacgcttccaggctttgcccgagttgatgccatgcttggctggaaccataaaaatgttaacgttacctttgccgcagccaatctgctcaatcaaaaatattggcgttcggactctatgccgggtaatccgcgcggctatactgcccgggtaaattaccgtttctga

SEQ ID NO: 41441 - protein, 703 aa, Neisseria meningitidis
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGAVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYNSRNKEVTTLPGFARVDAMLGWNHKNVNVTFAAANLLNQKYWRSDSMPGNPRGYTARVNYRF

SEQ ID NO: 41442 - DNA, 2112 bp, Neisseria meningitidis
atgaaaatatcatttcatttagctttattacccacgctgattattgcttccttccctgttgctgccgccgatacgcaggacaatggtgaacattacaccgccactctgcccaccgtttccgtggtcggacagtccgacaccagcgtactcaaaggctacatcaactacgacgaagccgccgttacccgcaacggacagctcatcaaagaaacgccgcaaaccatcgatacgctcaatatccagaaaaacaaaaattacggcacgaacgatttgagttccatcctcgaaggcaatgccggcatcgacgccgcctacgatatgcgcggcgaaagcattttcctgcgcggctttcaagccgacgcatctgatatttaccgcgacggcgtacgcgaaagcgggcaggtgcgccgtagcaccgccaacatcgagcgcgtggaaatcctgaaaggtccgtcctccgtgctttatgggcgtaccaacggcggcggtgtcatcaacatggtcagcaaatacgccaacttcaaacaaagccgtaatatcggtacggtttatggttcgtgggcaaaccgcagcctgaatatggacatcaacgaagtgctgaacaaaaacgtcgccatccgtctcaccggcgaagtcgggcgcgccaattcgttccgcagcggcatagacagcaaaaatgtcatggtttcgcccagcattaccgtcaaactcgacaacggcttgaagtggacggggcaatacacctacgacaatgtggagcgcacgcccgaccgcagtccgaccaagtccgtgtacgaccgcttcggactgccttaccgcatggggttcgcccaccggaacgattttgtcaaagacaagctgcaagtttggcgttccgaccttgaatacgccttcaacgacaaatggcgtgcccaatggcagctcgcccaccgcacggcggcgcaggattttgatcatttctatgcaggcagcgaaaatggcaacttaatcaaacgtaactacgcctggcagcagaccgacaacaaaaccctgtcgtccaacttaacgctcaacggcgactacaccatcggccgttttgaaaaccacctgaccgtaggcatggattacagccgcgaacaccgcaacccgacattgggtttcagcagcgccttttccgcctccatcaacccctacgaccgcgcaagctggccggcttcgggcagattgcagcctattctgacccaaaaccgccacaaagccgactcctacggcatctttgtgcaaaacatcttctccgccacgcccgatttgaaattcgtcctcggcggccgttacgacaaatacacctttaattccgaaaacaaactcaccggcagcagccgccaatacagcggacactcgttcagccccaacatcggcgcagtgtggaacatcaatcccgtccacacactttacgcctcgtataacaaaggcttcgcgccttatggcggacgcggcggctatttgagcatcgatacgttgtcttccgccgtgttcaacgccgaccccgagtacacccgccaatacgaaaccggcgtgaaaagcagttggctggacgaccgcctcagcactacgttgtctgcctaccaaatcgaacgcttcaatatccgctaccgccccgatccaaaaaacaacccttatatttatgcggttagcggcaaacaccgttcgcgcggcgtggaattgtccgccatcgggcaaatcatccccaaaaaactctatctgcgcggttcgttgggcgtgatgcaggcgaaagtcgttgaagacaaagaaaatcccgaccgagtgggcatccatttgaataacaccagcaacgttaccggcaacctgtttttccgttataccccgaccgaaaacctctacggcgaaatcggcgtaaccggtacaggcaaacgctacggttacgactcaagaaataaagaagtgactacgcttccaggctttgcccgagttgatgccatgcttggctggaaccataaaaatgttaacgttacctttgccgcagccaatctgttcaatcaaaaatattggcgttcggactctatgccgggtaatccgcgcggctatactgcccgggtaaattaccgtttctga

SEQ ID NO: 41443 - protein, 703 aa, Neisseria meningitidis; identical to SEQ ID NO: 24267

SEQ ID NO: 41444 - DNA, 444 bp, Neisseria meningitidis
atgaagtggttattaaatatgataatgagacctattaaatttagtatggtaaatacgttattatttattgttatatgtagttcattttttgatctgctcgttcaattatgtacaattttatttcatagccaaaaaatatactttattacattatttttattatttatttttaattttgttacaaaatctatctatatggcaattatttatcctattttatatttttttacgataaaaaaatattatccttactctaggaaagtgataattctattatcattagcattatctatatattttagttttatggacttttactttttttccatatattcagataaccttagctatgaaacggagcctttacatttatacatccctattattattaattttttctcacttttagtttctaattttattttatcttttatcaacaagtaa

SEQ ID NO: 41445 - protein, 147 aa, Neisseria meningitidis; identical to SEQ ID NO: 12005

SEQ ID NO: 41446 - DNA, 444 bp, Neisseria meningitidis; identical to SEQ ID NO: 41444

SEQ ID NO: 41447 - protein, 147 aa, Neisseria meningitidis; identical to SEQ ID NO: 12005

SEQ ID NO: 41448 - DNA, 1404 bp, Neisseria meningitidis
atgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccgacctggatagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggccgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataa

SEQ ID NO: 41449 - protein, 467 aa, Neisseria meningitidis; identical to SEQ ID NO: 12006

SEQ ID NO: 41450 - DNA, 1404 bp, Neisseria meningitidis
atgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccggcctggacagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggctgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataa

SEQ ID NO: 41451 - protein, 467 aa, Neisseria meningitidis; identical to SEQ ID NO: 24269

SEQ ID NO: 41452 - DNA, 1428 bp, Neisseria meningitidis
atgtttttctccgccctgaaatcctttctttctcgatacattactgtatggcgcaatgtttgggcggtgcgcgaccagttgaaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggcggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggctacctatacggtgggcggtgtggtgcaggctgcccaaaaaatgatggtgattgcgcccgatgacgacaaaatggacgtggaagttttggtattgaacaaagacatcggttttgtggaacagggacaggatgcggtggtgaagattgagagctttccctatacgcgctacggttatctgacgggcaaggtgaaaagtgtcagccatgatgcggtaagccacgaacagttgggcttggtttatacggcggtggtgtcgctggacaaacataccttgaatattgacggcaaagcagtgaatctgacggcgggcatgaatgtcacggcggagattaaaacgggtaaacggcgggtgctggattatctgttaagcccgctgcaaaccaaattggacgaaagctttagggagcgatag

SEQ ID NO: 41453 - protein, 475 aa, Neisseria meningitidis; identical to SEQ ID NO: 12007

SEQ ID NO: 41454 - DNA, 1305 bp, Neisseria meningitidis
atgtttttctccgccctgaaatcctttctttcccgctacattaccgtatggcgcaatgtttgggcggtgcgcgaccagttggaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggtggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggccacctatacggtgggcggtgtggtgcaggctgcccaaaaaatgatggtggttgcgcccgatgacgacaaaatggacgtggaagttttggtattgaacaaagacatcggttttgtggaacagggacaggatgcggtggtgaagattgagagttttccctatacgcgctacggttatctgacgggcaaggtgaaaagtgtcagccatgatgcggtaagccacgaacagttgggcttggtttatacggcggtggtgtcgctggacaaacataccttgaatattgacggcaaa

SEQ ID NO: 41455 - protein, 435 aa, Neisseria meningitidis; identical to SEQ ID NO: 24270

SEQ ID NO: 41456 - DNA, 930 bp, Neisseria meningitidis
atgttaagatgccgtccgaaatccgttttggattcagacggcatttttttgaaatttaattttttaaggagtaaacctaaatatgaaatttccttccttccttcctttaaacggatactctgcctgtcggcagtaatctcggtattgggggcttgtgcggtcgttgctgatgtttacggtcatgattccgccacaatgaacgctgcggctgccaaagattatatgaaaacggttgagttaaacaagtctgccggcaatgtcgataccacatccagaacagcccgcagggtgcaggcagtatttcgacgtatgctgccttatgccgatgcggcaaataataccagccataagtttgactggaaaatgacggttttcaaaaacgatgagctgaacgcgtgggcaatgcccggtggaaaaatggcgttttatacggggatagtcgacaaactcaagctgaccgatgacgaaattgccgccattatggggcatgaaatgacgcacgccctgcatgaacacggtaaaaataaggtcgggcagcaaatcttgaccaatacggcggcgcagataggcacgcagattatattagacaaaaaaccggatactaatccggaattggtcggattgggtatggatattttggggacgtacggtcttaccttgccttatagccgcagcttggaagaagaagccgatgaggggggaatgatgttgatggcgcaggcaggctatcatccggcggccgctgtcagggtttgggaaaaaatgaatcaggaaaacgaccaaaacggctttatttatgctattacctctactcatccgacaaacaatgcccgtatagaaaatctaaaacggttgttgccgaccgttatgccggtttatgagcaaagtgtcagaaataaggggcgcgttaataaaaaacgtcggcgttaa

SEQ ID NO: 41457 - protein, 309 aa, Neisseria meningitidis
MLRCRPKSVLDSDGIFLKFNFLRSKPKYEISFLPSFKRILCLSAVISVLGACAVVADVYGHDSATMNAAAAKDYMKTVELNKSAGNVDTTSRTARRVQAVFRRMLPYADAANNTSHKFDWKMTVFKNDELNAWAMPGGKMAFYTGIVDKLKLTDDEIAAIMGHEMTHALHEHGKNKVGQQILTNTAAQIGTQIILDKKPDTNPELVGLGMDILGTYGLTLPYSRSLEEEADEGGMMLMAQAGYHPAAAVRVWEKMNQENDQNGFIYAITSTHPTNNARIENLKRLLPTVMPVYEQSVRNKGRVNKKRRR

SEQ ID NO: 41458 - DNA, 930 bp, Neisseria meningitidis
atgttaagatgccgtccgaaatccgttttggattcagacggcatttttttgaaatttaattttttaaggagtaaacctaaatatgaaatttccttccttccttcctttaaacggatactctgcctgtcggcagtaatctcggtattgggggcttgtacggtcgttgctgatgtttacggtcaggattccgccacaatgaatgctgcggctgccgaagattatatgaaaacggttgagttgaacaagtctgccggcaatgtcgatactacatccaaaacagcccgtagggtgcaggcagtatttcgacgtatgttgccttatgccgatgcggcaaataataccggccataagtttgactggaaaatgacggttttcaaaaacgatgagctgaacgcgtgggcaatgcccggcgggaaaatggcgttttatacggggatagtcgataaacttaagctgaccgatggcgaaattgccgccattatggggcatgaaatgacgcatgccctgcatgaacacggtaaaaataaggtcgggcagaaaatcttgactaatatggcggcgcagataggcacgcagattatattagacaaaaaaccggacactaatccggaattggtcggattgggtatggatattttggggatgtacggcattaccttgccttatagccgcagcttggaagaagaagccgatgaggggggaatgatgttgatggcgcaggcaggctatcatccggcagccgctgtcagggtttgggaaaaaatgaatcaggaaaacgaccaaaacggctttatttatgctattacctctactcatccgacaaacaatgcccgtatagaaaatctaaaacggttgttgccgaccgttatgccggtttatgagcacagtgttagaaataaggggcgcgttaataaaaaccgtcggcgttaa

SEQ ID NO: 41459 - protein, 309 aa, Neisseria meningitidis
MLRCRPKSVLDSDGIFLKFNFLRSKPKYEISFLPSFKRILCLSAVISVLGACTVVADVYGQDSATMNAAAAEDYMKTVELNKSAGNVDTTSKTARRVQAVFRRMLPYADAANNTGHKFDWKMTVFKNDELNAWAMPGGKMAFYTGIVDKLKLTDGEIAAIMGHEMTHALHEHGKNKVGQKILTNMAAQIGTQIILDKKPDTNPELVGLGMDILGMYGITLPYSRSLEEEADEGGMMLMAQAGYHPAAAVRVWEKMNQENDQNGFIYAITSTHPTNNARIENLKRLLPTVMPVYEHSVRNKGRVNKNRRR

SEQ ID NO: 41460 - DNA, 645 bp, Neisseria gonorrhoeae
atgaagtttaaacatctgttgccgctgctgctgtcggcagtgttgtccgcgcaggcatatgccctgacggaaggggaagactatcttgtgttggataaacccattcctcaagaacagccgggaaaaattgaggttttggaatttttcggctatttttgcgtacattgccatcatttcgatcctttgttattgaaactgggcaaggcattgccgtctgatacttatctgcggacggagcacgtggtctggcggcctgaaatgctcggtctggcaagaatggctgctgcggtcaagctgtcgggtttgaaatatcaggcaaactctgctgtgtttaaagcagtttacgaacaaaaaatccgtttggaaaacagggctgttgccgggaaatgggctttatctcaaaaaggttttgacggcaaaaaactgatgcgcgcctatgattcccccgaagctgccgccgtcgcattaaaaatgcagaaactgacggaacaatacggtattgacagcacgccgaccgttattgtcggcggaaaataccgcgttatcttcaataatggctttgatggcggcgttcatacgattaaagaattggttgccaaagtcagggaagaacgcaagcgtcagacccctgctgtacagaaatag

SEQ ID NO: 41461 - protein, 214 aa, Neisseria gonorrhoeae
MKFKHLLPLLLSAVLSAQAYALTEGEDYLVLDKPIPQEQPGKIEVLEFFGYFCVHCHHFDPLLLKLGKALPSDTYLRTEHVVWRPEMLGLARMAAAVKLSGLKYQANSAVFKAVYEQKIRLENRAVAGKWALSQKGFDGKKLMRAYDSPEAAAVALKMQKLTEQYGIDSTPTVIVGGKYRVIFNNGFDGGVHTIKELVAKVREERKRQTPAVQK

SEQ ID NO: 41462 - DNA, 645 bp, Neisseria meningitidis
atgaagctcaaacatctgttgccgctgctgctgtcggcagtgttgtccgcgcaggcatatgccctgacggaaggggaagactatcttgtgttggataaacccattcctcaagaacagtcgggtaaaattgaggttttggaatttttcggctatttctgcgtacattgccatcatttcgatcctttgttattgaaactgggcaaggcattgccgtctgatgcctatttgaggacggagcacgtggtctggcagcctgaaatgctcggtttggctaggatggcggctgccgtcaatttgtcgggtttgaaatatcaggcaaaccctgctgtgtttaaagcagtttacgaacaaaaaatccgcttggaaaacaggtcggttgccggaaaatgggctttgtctcaaaaaggctttgacggcaaaaaactgatgcgcgcctatgattcccccgaagctgccgccgccgcattaaaaatgcagaaactgacggaacaataccgcatcgacagcacgccgaccgttattgtcggcggaaaataccgcgttatcttcaataacggctttgacggcggcgttcatacgattaaagaattggttgccaaagtcagggaagaacgcaagcgtcagacccctgctgtacagaaatag

SEQ ID NO: 41463 - protein, 214 aa, Neisseria meningitidis; identical to SEQ ID NO: 12024

SEQ ID NO: 41464 - DNA, 645 bp, Neisseria meningitidis
atgaagctcaaacatctgttgccgctgctgctgtcggcagtgttgtccgcgcaggcatatgccctgacggaaggggaagactatcttgtgttggataaacccattcctcaaaaacagtcgggcaaaattgaggttttggaatttttcggctatttctgcgtacattgccatcatttcgatcctttgttattgaaattgggcaaggcattgccgtctgatgcctatttaaggacggagcacgtggtctggcagcctgaaatgctcggtctggcaagaatggctgctgcggtcaagctgtcaggtttgaaatatcaggcaaaccctgccgtgtttaaagcagtttacgaacaaaaaatccgcttggaaaacaggtcggttgccgaaaaatgggctttgtctcaaaaaggctttgacggcaaaaaactgatgcgcgcctacgactctcctgcggcagcggctgctgcatcaaaaatgcagcaattgacggaacagtaccgcatcgacagtacgccgaccgttgtcgtcggcggaaaataccgcgttatcttcaataatggctttgacggcggtgttcatacgattaaagaattggttgccaaagtcagggaagaacgcaagcgtcagacccctgctgtacagaaatag

SEQ ID NO: 41465 - protein, 214 aa, Neisseria meningitidis
MKLKHLLPLLLSAVLSAQAYALTEGEDYLVLDKPIPQKQSGKIEVLEFFGYFCVHCHHFDPLLLKLGKALPSDAYLRTEHVVWQPEMLGLARMAAAVKLSGLKYQANPAVFKAVYEQKIRLENRSVAEKWALSQKGFDGKKLMRAYDSPAAAAAASKMQQLTEQYRIDSTPTVVVGGKYRVIFNNGFDGGVHTIKELVAKVREERKRQTPAVQK

SEQ ID NO: 41466 - DNA, 360 bp, Neisseria gonorrhoeae
atgaatatcaaacaattgattaccgccgcactcattgcctcagccgcctttgccacgcaggcagccccgcaaaaacccgtatccgccgcccaaaccgcgcaacattcagccgtttggatcgatgtccgttccgaacaggaatttagcgaaggtcatttgcacaacgcggtcaacatccccgtcgaccaaatcgtccgccgcatatacgaagccgcgcccgacaaagacacgccggtcaacctctactgccgcagcggacggcgtgccgaagccgcccttcaagagctgaaaaaagcaggttatacaaatgttgccaatcacggcggttatgaagacctgctcaaaaaagggatgaaatga

SEQ ID NO: 41467 - protein, 119 aa, Neisseria gonorrhoeae; identical to SEQ ID NO: 36085

SEQ ID NO: 41468 - DNA, 360 bp, Neisseria meningitidis
atgaatatcaaacacctgattaccgccgcactcattgcctcagccgcctttgccgcgcaggcagccccgcaaaaacccgtatccgccgcccaaaccgcgcaacatccggccgtttggatcgatgtccgttccgaacaggaatttagcgaagggcatttgcacaacgcggtcaacatccccgtcgaccaaatcgtccgccgcatacacgaagccgcgcccgacaaagacacgccggtcaacctctactgccgcagcggacggcgtgccgaagccgcccttcaagagctgaaaaaagcaggttatacaaatgttgccaatcacggcggttatgaagacctgctcaaaaaagggatgaaatga

SEQ ID NO: 41469 - protein, 119 aa, Neisseria meningitidis
MNIKHLITAALIASAAFAAQAAPQKPVSAAQTAQHPAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 41470 - DNA, 360 bp, Neisseria meningitidis
atgaatatcaaacacctgattaccgccgcactcattgcctcagccgcctttgccgcgcaggcagccccgcaaaaacccgtatccgccgcccaaaccgcgcaacattcagccgtttggatcgatgtccgcagcgaacaggaatttagcgaaggtcatttgcacaacgcggtcaacatccccgtcgaccaaatcgtccgccgcatacacgaagccgcgcccgacaaagacacgccggtcaacctctactgccgcagcggacggcgtgccgaagccgcccttcaagaactgaaaaaagcaggctatacgaatgttgccaatcacggcggttatgaagacctgctcaaaaaagggatgaaatga

SEQ ID NO: 41471 - protein, 119 aa, Neisseria meningitidis; identical to SEQ ID NO: 24309

SEQ ID NO: 41472 - DNA, 1476 bp, Neisseria gonorrhoeae
ttgataatggttattttttatttttatttttgtgggaagacatttatgcctgcacgaaacagatggatgctgctgcctttattggcaagcgcggcatacgccgaagaaacaccgtgcgaaccggatttgagaagccgtcccgagttcaggcttcatgaagcggaggtcaaaccgatcgacagggagaaggtaccggggcaggtgcgggaaaaaggaaaagttttgcaggttgacggcgaaaccctgctgaaaaatcccgaattgttgtcgcgtgccatgtattccgcagtggtctcaaacaatattgccggtatccgcgtgattttgccgatttacctacaacaggcgcggcaggataagatgttggcactttatgcacaagggattttggcgcaggcagagggcagggtgaaggaggcggtttcccattaccgggaattgattgccgcccaacccgacgcgcccgccgtccgtatgcgtttggcggcggcattgtttgaagacaggcagaacgaggcggcggcagaccagttcgaccgcctgaaaacagaagatctgccgccgcagcttatggagcaggtcgagctgtaccgcaaggcattgcgcgaacgcgatgcgtggaaggtaaacggcggtttcagcgttacccgcgaacacaatatcaaccaagccccgaaacagcagcagtacggcaattggactttcccgaaacaggtggacggcacggcagtcaattaccggttcggcgcggagaaaaaatggtcgctgaaaaacggctggtacacgacggcgggcggcgacgtgtccggcagggtttatccggggaataagaaattcaacgatatgacggcaggtgtttccggcggcatcggttttgccgaccggcgtaaagatgtcgggctggcagtgttccacgaacgccgcacctacggcaacgacgcttattcttacgccaacggcgcacgcctttatttcaaccgttggcaaaccccgagatggcaaacgctgtcttcggcggagtgggggcgtttgaagaatacgcgccgggcgcgttccgacaatacccatttgcaaatttccaattcgctggtgttttaccggaatgcgcgccaatattggacgggcggtttggatttttaccgcgagcgcaaccccgccgaccgtggcgacaatttcaaccgttacggcctgcgctttgcctgggggcaggaatggggcggcagcggcctgtcttcgctgttccgcctcggcgtggcgaaacggcattatgaaaaacccggcttcttcagcagttttaaaggggaaaggcgcagggataaagaatcggacacatccttgagcctttggcaccgggcattgcatttcaaaggcatcacgccgcgcctgacgctgtcgcaccgcgaaacgtggagcaacgatgtgtttaacgaatacgagaaaaacagggcgtttgtcgagtttaacaaaacgttctga

SEQ ID NO: 41473 - protein, 491 aa, Neisseria gonorrhoeae; identical to SEQ ID NO: 36086

SEQ ID NO: 41474 - DNA, 1473 bp, Neisseria meningitidis
ttgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 41475 - protein, 490 aa, Neisseria meningitidis; identical to SEQ ID NO: 12038

SEQ ID NO: 41476 - DNA, 1473 bp, Neisseria meningitidis
ttgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccaatcgacagggagaaggtaccggggcaggtgcgggaaaaaggaaaagttttgcagattgacggcgaaaccctgctgaaaaatcccgaattgctgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgtcgcccaacccgacgcgcccgccgtccgtatgcgtttggcggcggcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgttacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 41477 - protein, 490 aa, Neisseria meningitidis; identical to SEQ ID NO: 24310

SEQ ID NO: 41478 - DNA, 561 bp, Neisseria gonorrhoeae
atgaacagactgctactgctgtctgccgccgtcctgccgactgcctgcggcagcggcgaaaccgataaaatcggacgggcaagtaccgttttcaacatgttgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaagcgcggtacgggcttcgcgttcaagagccggcagattgtccgttattacgaccccaaacgcaaagccttcgcctatttggtttacagcgataaaatcgtccaaggatcgccgaaaaattccttaagcgcggtttcctgtttcggcagcggcataccgcaaaccgacggggtgcaagccgatacttccggcaaactgcttgccggcgcctgcattatttccaacccgataaaaaatcccgacaaacgctga

SEQ ID NO: 41479 - protein, 186 aa, Neisseria gonorrhoeae; identical to SEQ ID NO: 36087

SEQ ID NO: 41480 - DNA, 561 bp, Neisseria meningitidis
atgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatctcgacaaacgctga

SEQ ID NO: 41481 - protein, 186 aa, Neisseria meningitidis; identical to SEQ ID NO: 12039

SEQ ID NO: 41482 - DNA, 561 bp, Neisseria meningitidis
atgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatcccgacaaacgctga

SEQ ID NO: 41483 - protein, 186 aa, Neisseria meningitidis; identical to SEQ ID NO: 24311

SEQ ID NO: 41484 - DNA, 2103 bp, Neisseria gonorrhoeae
atggatttattatcggttttccacaaataccgtctgaaatatgcggtggcggtgctgacgatgctgcttttggcggcagtcgggctgcacgcttccgtatatcgcaccttcacgcccgaaaacatccgcagccgcctccaacaaagcattgcccatacccaccggaaaatctcgtttgatgcggatatacggcgcaggcttctgccccgcccgaccgtcatcctgaaaaacctgaccattaccgaacccgacggcggccgggtcgccgtttccgtcaaagaaaccaaaatcggattgagctggaaaaacctgtggtcggatcggatacaggttgaaaaatgggtggtttcgggtgcggatcttgccctgacgcgcgacagaaacggcgcttggaacatccaagacctgttcgacggcgcgaaacactccgcctcagtcaaccgcattatcgtcgaaaacagcaccgtccgcctcaatttcctgcagcaacagcttatcctgaaggaaatcagcctcaacctgcaatcccccgattcgtcggggcagcagtttgaaagttcgggcatactggtttggagaaagctgtccgtcccgtggaaaagcagggggctgttcctttcagacggcatcggcacgcccgaaatctcaccgttccattttgaagcttccacttcgctggacggacacggcatcaccatttccaccaccggcagcccttctgtccgcttcaacgccggcggagcggatgccgccggcctcggcctgcgtgcagacacttccttccgcaacctccacctgaccgcgcaaatccccgcactggcactcaaaaacaacagcatcaaaaccggcacggtcaacggcacgtttaccgccggcggcgaatatgcccgatgggacggttcgttcaaactcgacaaagccaacctgcactccggcatcgccaacatcggcaacgccgaaatctccggcagcttcaaaacaccgcgccttcaaaccaatttctccctcggctcgccgttggtttggagtcgggacaacgggctggacgccccgcgcctgcacatatcgacccttcaggataccgtcgaccgcctgccgcaaccccgtttcatcagccggctcgacggttcgctgtccataccgaatctgcaaaattggaatgccgaattaaacggcacattcgaccgccaacccgttgccgcaaaattcaaatatacgcgggaaggcgcaccgcacctggaagccgccgccgcgctgcaaaaattaaacctcgccccctatcttgacgaatttcggcaacaaaacggcaaaatattccccgacatcctcggcaggctgtccggcaacgtcgaggcacacctcaaaatcggcagcatccaactccccggcttgcaactggacgatatggaaacctacctccacgccgacaaagaccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgatgcggtcatcgacctgaccgcaagcggcgaaaaccgcaaacagcttatccgctcgctgcaaggcagcctgtcgctgaatatttccaacggcgcgtggcacggcatcgatatggacagcattttaaaaaacggcctttccgggaaaatctcgggcagcacacccttctaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggtacggtggacaagccgtccattaccgtcgattacggcaggctgaccggcggcatcaattcgcgcaaagagaaacagaaaatcctcgaagacaccctgctggaacaatggcagtggctcaaacctaaagaaccgtaa

SEQ ID NO: 41485 - protein, 700 aa, Neisseria gonorrhoeae
MDLLSVFHKYRLKYAVAVLTMLLLAAVGLHASVYRTFTPENIRSRLQQSIAHTHRKISFDADIRRRLLPRPTVILKNLTITEPDGGRVAVSVKETKIGLSWKNLWSDRIQVEKWVVSGADLALTRDRNGAWNIQDLFDGAKHSASVNRIIVENSTVRLNFLQQQLILKEISLNLQSPDSSGQQFESSGILVWRKLSVPWKSRGLFLSDGIGTPEISPFHFEASTSLDGHGITISTTGSPSVRFNAGGADAAGLGLRADTSFRNLHLTAQIPALALKNNSIKTGTVNGTFTAGGEYARWDGSFKLDKANLHSGIANIGNAEISGSFKTPRLQTNFSLGSPLVWSRDNGLDAPRLHISTLQDTVDRLPQPRFISRLDGSLSIPNLQNWNAELNGTFDRQPVAAKFKYTREGAPHLEAAAALQKLNLAPYLDEFRQQNGKIFPDILGRLSGNVEAHLKIGSIQLPGLQLDDMETYLHADKDHIALSRFKSGLYGGHTEGGISIANTRPATYRLQQNASNIQIQPLLQDLFGFHSFSGNGDAVIDLTASGENRKQLIRSLQGSLSLNISNGAWHGIDMDSILKNGLSGKISGSTPFYRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 41486 - DNA, 2114 bp, Neisseria meningitidis
atggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgta

SEQ ID NO: 41487 - protein, 704 aa, Neisseria meningitidis
MDLLSVFHKYRLKYAVAVLTILLLAAVGLHASVYRTFTPENIRSRLQQSIAHTHRKISFDADIQRRLLPRPTVILKNLTITEPGGDQTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSNGIGPPEISPFHFEASTSLDGHGITISTTGSPSVRFNAGGADAAGLGLRADTSFRNLHLTAQIPALALRNNSIKIETVNGAFTAGGEYARWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 41488 - DNA, 2115 bp, Neisseria meningitidis
atggatttattatcggtcttccacaaataccgtctgaaatatgcggtagccgtgctgacgatactgcttttggcggcaatcgggctgcacgcttccgtatatcgcatcttcacacctgaaaacatccgaagccgcctccaacaaagcattgcccatacgcaccggaaaatctcgtttgatgcggatatacagcgcaggcttctgccccggccgaccgtcatcctgaaaaacctgaccattaccgaacccggcggcgaccggactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcagacggcatcggcacgcccaaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccctacgctggcactcaggaacaacagcattaaaattgaaaccgtcaacggcgcatttaccgccggcggcgaatatgcccaatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggtacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaa

SEQ ID NO: 41489 - protein, 704 aa, Neisseria meningitidis; identical to SEQ ID NO: 24312

SEQ ID NO: 41490 - DNA, 897 bp, Neisseria gonorrhoeae
gtgttcggcacggtcttgcggactgatgccgactgcctgcaaatcatcgtcgtcggcaagttctttcaggttgttgcgtatggttttgcggcgttggcggaaggcgagtttcaccagtttggcgaaatgatcgaaatcgtccgccttgccgatacggtgtttcaccggaatcatgcgcaccactgcggaatcgattttcggcgcgggatcgaacgattcgggcggcacgtcaatcagcagctccatatcgaaaaaatattgcagcatcacacccaagcgaccgtagtcgttgcttttcggcgcggcaaccatgcgctcgaccacttctttttgcaacataaagtgcatatcggcgacatcgtccgccacctccgccagtttgaacaaaagcggcgtggagatgttatacggcaggttgccgacgattttctttttgcctgagatgccgttgaaatcaaactgcaacacgtcgccttcgtgaatcaccagtttatccgcaaacggcagcgttttcagacggcatacgatgtcgcggtcgatttcgacaacgtgcaggcggttcagctttttcgccaaaggttcggtaattgccgccaaacccgggccgatttcaatcacgacatcatccgcctgcgggcgcacggcgttgacaatatcgccgataatccgcgtgtcctgcaaaaaattctgcccgaaacgcttgcgggctttgtgttctttcatcgtgtttcctcttcggttgaaaccccgccctttagggcggcaggatcagactctgtttgggcggggcgtaaccccttccaaatcaggacgacacatagggcggtgctttatgtgtcgtcctgtgtgttggaacataaatgtgtttacagtatccgtttgatgtcggcattgtaa

SEQ ID NO: 41491 - protein, 297 aa, Neisseria gonorrhoeae; identical to SEQ ID NO: 36162

SEQ ID NO: 41492 - DNA, 897 bp, Neisseria meningitidis
atgttcggcgcggtcttgcggattgatgccgactgcctgcaaatcatcgtcgcctgcaagctctttcagattgttgcgtatggttttgcggcgttggtggaaggcgagtttcacgagtttggcaaaatgctcgaaatcgtccgccttgccgatgcggtgtttcaccggaatcatacggacgacggcggaatccactttcggcgcagggtcgaacgattcgggcggtacgtcaatcagcatttccatatcgaaaaaatattgcagcatcacgcccaagcggccgtagtcgttgcttttcggcgcggcaaccatacgctcgaccacttctttttgcagcataaagtgcatatcgacgacatcgtccgccacctccgccagcttgaacaaaagcggtgtggaaatgttgtacgggaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccgggccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactctttccaaatcaggatggcacatagggcggtgctttatgtgtcgtcctgtgtgttgaaacataaatgtgtttacagtatccgtttgatgtcggcattgtaa

SEQ ID NO: 41493 - protein, 298 aa, Neisseria meningitidis; identical to SEQ ID NO: 12041

SEQ ID NO: 41494 - DNA, 897 bp, Neisseria meningitidis
atgttcggcgcggtcttgcggattgatgccgactgcctgcaaatcatcgtcgcctgcaagctctttcagattgttgcgtatggttttgcggcgttggtggaaggcgagtttcacgagtttggcgaaatgctcgaaatcgtccgccttgccgatacggtgtttcaccggaatcatgcggacgacggccgaatccactttcggcgcggggtcgaacgattcgggcggcacgtcaatcagcatttccatatcgaagaaatattgcagcatcacgcccaagcggccgtagtcgttgcttttcggcgcggcaaccatacgatcgaccacttctttttgcagcataaagtgcatatcgacgacatcgtccgccacctccgccagcttgaacaaaagcggcgtggaaatgttgtagggcaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccggaccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactccttccaaatcaggacggcacatagggcggtgctttatgtgtcgtcctgtgtgttgaaacataaatgtgtttacagtatccgtttgatgtcggcattgtaa

SEQ ID NO: 41495 - protein, 298 aa, Neisseria meningitidis; identical to SEQ ID NO: 24313

SEQ ID NO: 41496 - DNA, 783 bp, Neisseria meningitidis
atgggattgggtgcaacgacttttgtcggttcgggtgctataggcggaggtctgtgcagtaccgggattggctgtgcggccggtggacttattgcaacggcaggtatgaccggtggttatacacaggcctcagaaggaagccggcaattgtttggcacttaccagtccgattttggtaaaaaagttgtcctatctttgggtacaccaatagaatacgaatcgccgttagtatctgatgcgaaaaatctagccgtatggggattggaaacgctgattacgcgcaaattgggaaacttggcaacgggtgtgaaaacttccttgactccgaaaactgctgacgtacagcgaaatatcctgtcccaatccgaagtcggtatcaagtggggcaaggggattgaaggacagggaatgccttgggaggattatgtcggtaagggcttgtctgccaatgcaaggttacctaaaaattttaaaacatttgattattttgatcgtggtacaggcacggcaatcagtgccaaaactctggatacgcaaactacggcacgcctgtccaaacccgaacagctttacagtaccatgaaagggtacatcgataagacggcaaatttcaaaagttatgaattatcagaagtaccgttaagggcagacatgatcaaacagcgcgaaatccatctggccatacccgcacaaactaataaggagcaaagattgcagttgcaacgtgtggtagagtatggcaaaagtcaaaacattacagtcaaaattacggagatcgaataa

SEQ ID NO: 41497 - protein, 260 aa, Neisseria meningitidis; identical to SEQ ID NO: 12042

SEQ ID NO: 41498 - DNA, 714 bp, Neisseria gonorrhoeae
atgaagaccaaattaccgctttttatcatttggctgtctgtgtctgcctcctgtgcttccgttttacccgttccggagggcagccgaaccgaaatgccgacacaggaaaatgcttcagacggcattccctatcccgttcccactctgcaagaccgtttggactatctggaaggcaaaatcgtccggctgtcgaacgaagtggaaatgttaaacgggaaagtcaaagcattggagcatacgaaaatacacccttccggcaggacatacgtccaaaaactcgacgaccgcaaattgaaagagcattacctcaataccgaaggcggcagcgcatccgcacataccgtcgaaaccgcacaaaacctctacaatcaggcactcaaacactatcaaaacggcaggttttctgccgcagccgccttgttgaagggggcggacggcggagacggcggcagcatcgcgcaacgcagtatgtacctgttgctgcaaagcagggcgcgtatggggaactgtgaatctgtcatcgaaatcggagggcgttacgccaaccgtttcaaagacagcccaaccgcgcccgaagtcatattcaaaatcggcgaatgccaatacaggcttcagcaaaaagacattgcaagggcgacttggcgcagcctgatacagacctatcccggcagcccggcggcaaaacgcgccgccgcagccgtacgcaaacgatag

SEQ ID NO: 41499 - protein, 237 aa, Neisseria gonorrhoeae
MKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 41500 - DNA, 714 bp, Neisseria meningitidis
atgaagatcaaattaccgctttttatcatttggctgtctgtgtccgcctcctgtgcttccgtttcacccgttccggcaggcagccaaaccgaaatgtcgacacgggaaaatgcttcagacggcattccctatcccgttccgaccttgcaagaccgtttggactatctggaaggcaaaatcgtccggctgtcgaacgaagtggaaaccttaaacggcaaagtcaaagcactggaacacgcaaaaacacattcttccggcagggcatacgtccaaaaactcgacgaccgcaagttgaaagagcattacctcaataccgaaggcggcagcgcatccgcacatactgtcgaaaccgcacaaaacctctacaatcaggcactcaaacactataaaagcggcaagttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 41501 - protein, 237 aa, Neisseria meningitidis; identical to SEQ ID NO: 12043

SEQ ID NO: 41502 - DNA, 717 bp, Neisseria meningitidis
atgaagaccaaattaccgctttttatcatttggctgtccgtatccgccgcctgttcttcccctgtttcccgcaatattcaggatatgcggctcgaaccgcaggcagaggcaggtagttcggacgctattccctatcccgttcccactctgcaagaccgtttggattatctggaaggcacactcgtccgcctgtcgaacgaagtggaaaccttaaacggcaaagtcaaagcactggagcatgcgaaaacacacccttccagcagggcatacgtccaaaaactcgacgaccgcaagttgaaagagcattacctcaataccgaaggcggcagcgcatccgcacataccgtcgaaaccgcacaaaacctctacaatcaggcactcaaacactataaaagcggcaggttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 41503 - protein, 238 aa, Neisseria meningitidis; identical to SEQ ID NO: 24314

SEQ ID NO: 41504 - DNA, 1029 bp, Neisseria meningitidis
atggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcatagtccttaacgatgtccaaggcgatacgaccatcaacaaccatcatacgcatacgcacaaccacagcgatgccgatggcaaagcactgtcgatgaggctcacaccccgtcctttgttgtcagaccgtcaggcggcggctttcgcccgtacaggcaaactcacgggcagtttcgacctgtttgcttcggtggtcgccccctcgcagtacacgtttgccgttgccatgcccgacacgtccatgtcgccggttatcgaaaagggagacttgctggtggtcgagccgcgtatgtgccctgcggacgaagacatcgcgctgattgaactgtccgacaagcggctggtcgtcgcgcaccttgttatcgatattgcgggcaggatgctgatttatcagacgggcaggccgtctgaagcctttgacctgcccgaaggcagcacgattttaggtgtggtgctggagtcaaaaaacggtttatgtccgccgcacaggcaagaaggcgtgttgattcggattaccgcccctgatgtgtggacggttggtatgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctga

SEQ ID NO: 41505 - protein, 342 aa, Neisseria meningitidis
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIVLNDVQGDTTINNHHTHTHNHSDADGKALSMRLTPRPLLSDRQAAAFARTGKLTGSFDLFASVVAPSQYTFAVAMPDTSMSPVIEKGDLLVVEPRMCPADEDIALIELSDKRLVVAHLVIDIAGRMLIYQTGRPSEAFDLPEGSTILGVVLESKNGLCPPHRQEGVLIRITAPDVWTVGMISASKTSCTRPTAARKSAVCFLRFWQATRGIPKTRSWRNPNNA

SEQ ID NO: 41506 - DNA, 1029 bp, Neisseria meningitidis
atggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcataatccttaacgatgtccaaggcgatacgaccatcaacaaccatcatacgcatacgcacaaccacagcgatgccgacggcaaagcactgtcgatgaggctcacaccccgtcctttgttgtcagaccgtcaggcggcggctttcgcccgtacaggcaaactcacgggcagtttcgacctgtttgcttcggtggtcgccccttcacaatatacgtttgccgttgccatgcccgacacgtccatgtcgccggttatcgaaaagggggatttgctggtggtcgagccgcgtatgcgccctgcggacgaagacatcgtactgattgaactgtccgacaagcggctggtcgtcgcgcaccttgttatcgatattgcgggcaggatgctgatttatcagacgggcaggccgtctgaagccctcgacctgcccgaaggcagcgtgattttaggtgtggtgctggagtcaaaaaacggtttatgtccgccgcacaggcaagaaggcgtgttgattcggattaccgcccctgatgtgtggacggttggtacgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctgt

SEQ ID NO: 41507 - protein, 343 aa, Neisseria meningitidis
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIILNDVQGDTTINNHHTHTHNHSDADGKALSMRLTPRPLLSDRQAAAFARTGKLTGSFDLFASVVAPSQYTFAVAMPDTSMSPVIEKGDLLVVEPRMRPADEDIVLIELSDKRLVVAHLVIDIAGRMLIYQTGRPSEALDLPEGSVILGVVLESKNGLCPPHRQEGVLIRITAPDVWTVGTISASKTSCTRPTAARKSAVCFLRFWQATRGIPKTRSWRNPNNAC

SEQ ID NO: 41508 - DNA, 2418 bp, Neisseria gonorrhoeae
atggtaaattattattcagctatgattaaaaagattttaactacttgttttggtttgttttttggtttttgtgtatttggagtgggtctggttgccattgctattttggtaacgtatccgaaactgccgtctttggattctttgcagcattaccagcctaaaatgccgttgactatttattcggcggatggagaagtcatcggtatgtatggggagcagcggcgcgaatttacaaaaatcggcgatttccccgaggtgttgcggaatgcggttattgccgccgaggataaacgcttttaccggcattggggggtggatgtttggggtgttgcccgcgctgccgtcggcaatgtcgtgtccggcagcgtgcagtcgggtgcgagtacgattacacagcaggtggcgaaaaatttttatttgagcagtgaaaaaacgttcacacgcaaattcaatgaggtgttgcttgcctataaaatcgagcagtctttaagcaaagacaaaatccttgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccggagcgtgccaagttgcgccagaagtatattttgaacaatatgctcgaggagaagatgattaccgtgcaacagcgcgatcaggcattgaatgaggaactgcattatgagcggtttgttcggaaaatcgatcagagtgctttatatgtggcggaaatggtgcgtcgggaactgtatgagaaatatggtgaagatgcctatacgcagggttttaaggtttataccacggtccgcaccgatcatcagaaggcggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgttactaaaaagaaaaatgtcgtcatacagctgcccggcggcaggcgggttgcgcttgacaggcgcgccttgggttttgcggcccgagcggtcgataatgagaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggccgtccgagctgccggcaagcctgtctatggctttaggtacgggcgagacgacgccgttgaaagtggcggaggcatatagtgtatttgcgaacggcggatatagggtttcttcgcacgtgatcgataagatttatgacagagacggcaggttgcgcgcccaaatgcaacctttggtggcagggcaaaatgcgcctcaggcaatcgatccgcgcaatgcctatattatgtataagattatgcaggatgtggtccgtgtcggtacggcaaggggggcagctgcgttgggaagaacggatattgccggtaaaacgggtacgaccaacgacaataaagatgcgtggtttgtcggttttaaccctgatgtggttactgccgtatatatcggcttcgacaaacctaagagtatggggcgtgccggctacggcggtacgattgcggtgccggtttgggtggactatatgcgttttgcgttgaaaggaaagcagggcaaagggatgaaaatgcctgaaggtgtggtcagcagcaatggcgaatactatatgaaggaacgtatggtaaccgatccgggcttgatgctggacaacagcggtattgcgccgcaaccttcccgacgggcaaaagaagatgatgaagcggcagtagaaaacgaacagcagggaaggtctgacgaaacgcgtcaggacgtacaggaaacgccggtgcttccgagcaatacggattccaaacagcagcagttggattccctgttttaa

SEQ ID NO: 41509 - protein, 800 aa, Neisseria gonorrhoeae
MVNYYSAMIKKILTTCFGLFFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRRELYEKYGEDAYTQGFKVYTTVRTDHQKAATEALRKALRNFDRGSSYRGAENYIDLSKSEDVEETVSQYLSGLYTVDKMVPAVVLDVTKKKNVVIQLPGGRRVALDRRALGFAARAVDNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRPSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRAGYGGTIAVPVWVDYMRFALKGKQGKGMKMPEGVVSSNGEYYMKERMVTDPGLMLDNSGIAPQPSRRAKEDDEAAVENEQQGRSDETRQDVQETPVLPSNTDSKQQQ

SEQ ID NO: 41510 - DNA, 2418 bp, Neisseria meningitidis
atggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgcgttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttgggttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggctgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaa

SEQ ID NO: 41511 - protein, 805 aa, Neisseria meningitidis
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALGSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 41512 - DNA, 2420 bp, Neisseria meningitidis
asatggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgctttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggccgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaa

SEQ ID NO: 41513 - protein, 805 aa, Neisseria meningitidis
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 41514 - DNA, 768 bp, Neisseria gonorrhoeae
atgttccgcatcgtcaaatggctgattgccctgcccgtcggcatctttatctttttcaatgcctatgtgtacggcaacatcatcacctaccgcgccgtcgcgccccatcggactgcctttatgtcgatgcggatgaagcagtttgaacaagaaggtcgcgatgtcgcactggattaccgctgggtgccctacaaccgcatttccaccaacctgaaaaaagccctgattgcttccgaagatgtccgttttgccggacacgggggcttcgatggggacggcattcaaaacgccatcaggcgcaaccggaacagcggcgaagtgaaggcgggcggatcgaccatcagccagcagcttgccaaaaacctcttcctcaacgaaagccgcaactatctgcgcaaaggggaagaggcggccattacggcaatgatggaagctgttaccgacaaaaacaggattttcgaactgtatttaaactcaatcgaatggcactacggcgttttcggcgcggaagctgcgtcccggtatttttataaaaaaccggccgcagacctgaccaaacagcaggcggcgaaactgacggtactcgtccccgccccgttttactactctgaccatccaaaaagcaaacggctgcgcaacaaaaccaatatcgtgctcagacgcatgggttcggcaaattaccccaaagcgaaacggactgattgttccagatatggaaatgccgcctgaactggggttcgaacggcatatgttttctgggacttataa

SEQ ID NO: 41515 - protein, 254 aa, Neisseria gonorrhoeae
MFRIVKWLIALPVGIFIFFNAYVYGNIITYRAVAPHRTAFMSMRMKQFEQEGRDVALDYRWVPYNRISTNLKKALIASEDVRFAGHGGFDGDGIQNAIRRNRNSGEVKAGGSTISQQLAKNLFLNESRNYLRKGEEAAITAMMEAVTDKNRIFELYLNSIEWHYGVFGAEAASRYFYKKPAADLTKQQAAKLTVLVPAPFYYSDHPKSKRLRNKTNIVLRRMGSANYPKAKRTDCSRYGNAATGVRTAYVFWDL

SEQ ID NO: 41516 - DNA, 702 bp, Neisseria meningitidis
atgttccgcatcatcaaatggctgattgccctgcccgtcggcatctttatctttttcaatgcctatgtgtacggcaacatcattacctaccgcgccgtcgcgccccatcggactgcctttatgtcgatgcggatgaagcagtttgaacaggaaggtcgcgatgtcgcactggattaccgctggatgccctacaaacgcatttccaccaacctgaaaaaagccctgattgcttccgaagatgcccgtttcgccgggcacggcggcttcgattggggcggcattcaaaacgccatcaggcgcaaccggaacagcggcaaagtgaaggcgggcggctcgaccatcagccagcagcttgccaaaaacctgtttttaaacgaaagccgcagctatatccgcaaaggcgaagaagcggcgattaccgcgatgatggaagccgttaccgacaaagacaggatttttgaactgtatttaaactcaatcgaatggcactacggcgttttcggcgcggaagccgcgtcccggtatttttatcaaatacccgccgccaagctgaccaaacagcaggcggcaaaactgacggcgcgcgtccccgccccgctctactacgccgaccatccgaaaagcaaacggctccgcaacaaaaccaatatcgtgctcaaacgcatgggttcggcagagttgcctgaaagcgacacggactga

SEQ ID NO: 41517 - protein, 233 aa, Neisseria meningitidis
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLKRMGSAELPESDTD

SEQ ID NO: 41518 - DNA, 702 bp, Neisseria meningitidis
atgttccgcatcatcaaatggctgattgccctgcccgtcggcatctttatctttttcaatgcctatgtgtacggcaacatcattacctaccgcgccgtcgcgccccatcggactgcctttatgtcgatgcggatgaagcagtttgaacaggaaggtcgcgatgtcgcactggattaccgctggatgccctacaaacgcatttccaccaacctgaaaaaagccctgattgcttccgaagatgcccgtttcgccgggcacggcggcttcgattggggcggcattcaaaacgccatcaggcgcaaccggaacagcggcaaagtgaaggcgggcggctcgaccatcagccagcagcttgccaaaaacctgtttttaaacgaaagccgcagctatatccgcaaaggcgaagaagcggcgattaccgcgatgatggaagccgttaccgacaaagacaggatttttgaactgtatttaaactcaatcgaatggcactacggcgttttcggcgcggaagccgcgtcccggtatttttatcaaatacccgccgccaagctgaccaaacagcaggcggcaaaactgacggcgcgcgtccccgccccgctctactacgccgaccatccgaaaagcaaacggctccgcaacaaaaccaatatcgtgctcagacgcatgggttcggcagagttgcctgaaagcgacacggactga

SEQ ID NO: 41519 - protein, 233 aa, Neisseria meningitidis
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLRRMGSAELPESDTD

SEQ ID NO: 41520 - DNA, 1749 bp, Neisseria gonorrhoeae
atgttgattaaaagcgaatataagccccggatgctgcccaaagaagagcaggtcaaaaagccgatgaccagtaacggacggattagcttcgtcctgatggcaatggcggtcttgtttgcctgtctgattgcccgcgggctgtatctgcagacggtaacgtataactttttgaaagaacagggcgacaaccggattgtgcggactcaagcattgccggctacacgcggtacggtttcggaccggaacggtgcggttttggcgttgagcgcgccgacggagtccctgtttgccgtgcctaaagatatgaaggaaatgccgtctgccgcccaattggaacgcctgtccgagcttgtcgatgtgccggtcgatgttttgaggaacaaactcgaacagaaaggcaagtcgtttatttggatcaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgtatggcgaagacggcgcggaagttgttttgcgggaccggcagggcaatattgtggacagcttggactccccgcgcaataaagcaccgcaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacagacccggccgggcagacagcgaacagcggcgcaaccgtgccgtaaccgatatgatcgaacctggttcggcaatcaaaccgttcgtgattgcgaaggcattggatgcgggcaaaaccgatttgaacgaacggctgaatacgcagccttataaaatcggaccgtctcccgtgcgcgatgatacccatgtttacccctctttggatgtgcgcggcattatgcagaaatcgtccaacgtcggcacaagcaaactgtctgcgcgtttcggcgccgaagaaatgtatgacttctatcatgaattgggcatcggtgtgcgtatgcactcgggctttccgggggaaactgcaggtttgttgagaaattggcgcaggtggcggcccatcgaacaggcgacgatgtctttcggttacggtctgcaattgagcctgctgcaattggcgcgcgcctataccgcactgacgcacgacggcgttttgctgccgctcagctttgagaagcaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgctaaaaccggcacggcgcgcaagttcgtcaacgggcgttatgccgacaacaaacacgtcgctacctttatcggttttgcccccgccaaaaacccccgtgtgattgtggcggtaaccatcgacgaaccgactgcccacggctattacggcggcgtagtggcagggccgcccttcaaaaaaattatgggcggcagcctgaacatcttgggcatttccccgaccaagccactgaccgccgcagccgtcaaaacaccgtcttaa

SEQ ID NO: 41521 - protein, 582 aa, Neisseria gonorrhoeae
MLIKSEYKPRMLPKEEQVKKPMTSNGRISFVLMAMAVLFACLIARGLYLQTVTYNFLKEQGDNRIVRTQALPATRGTVSDRNGAVLALSAPTESLFAVPKDMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLYGEDGAEVVLRDRQGNIVDSLDSPRNKAPQNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPLSFEKQAVAPQGKRIFKESTAREVRNLMVSVTEPGGTGTAGAVDGFDVGAKTGTARKFVNGRYADNKHVATFIGFAPAKNPRVIVAVTIDEPTAHGYYGGVVAGPPFKKIMGGSLNILGISPTKPLTAAAVKTPS

SEQ ID NO: 41522 - DNA, 1746 bp, Neisseria meningitidis
atgttgattaagagcgaatataagcctcggatgctgcccaaagaagagcaggtcaaaaagccgatgaccagtaacggacggatcagcttcgtcctgatggcaatagcggtcttgtttgccggtctgattgctcgcggactgtatctgcagacggtaacgtataactttttgaaagaacagggcgacaaccggattgtgcggactcaaacattgccggctacacgcggtacggtttcggaccggaacggtgcggttttggcgttgagtgcgccgacggagtccctgtttgccgtgcctaaagagatgaaggaaatgccgtctgccgcacaattggaacgcctgtccgagcttgtcgatgtgccggttgatgttttgaggaacaagctcgaacagaaaggcaagtcgtttatctggattaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgcatggcgaagacggcgcggaagtcgttttgcgggaccggcagggcaatattgtggacagcttggactccccgcgcaataaagccccgaaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacaggcccggccgggcagacagcgaacagcggcgcaaccgtgccgtaaccgatatgatcgaacccggttcggcaatcaaaccgtttgtgattgcgaaggcattggatgcgggcaaaaccgatttgaacgaacggctgaatacgcagccttataaaatcggaccgtctcccgtgcgcgatacccatgtttacccctctttggatgtgcgcggcatcatgcagaaatcgtccaacgtcggcacaagcaaactgtctgcgcgtttcggtgccgaagaaatgtatgacttctatcatgagttgggcatcggtgtgcgtatgcactcgggctttccgggcgaaactgcaggtttgttgagaaattggcgcaggtggcggcctatcgaacaggcgacgatgtctttcggttacggcctgcaattgagcctgctgcaattggcgcgcgcctataccgcactgacgcacgacggcgttttactgccggtcagctttgaaaaacaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgcgaaaaccggcacggcgcgcaagttcgtcaacgggcgttatgccgacaacaaacacatcgctacctttatcggttttgcccccgccaaaaatccccgtgtgattgtggcggtaaccattgacgaaccgactgcccacggttattacggcggcgtagtggcagggccgcccttcaaaaaaattatgggcggcagcctgaacatcttgggcatttccccgaccaagccactgaccgccgcagccgtcaaaacaccgtcttaa

SEQ ID NO: 41523 - protein, 581 aa, Neisseria meningitidis
MLIKSEYKPRMLPKEEQVKKPMTSNGRISFVLMAIAVLFAGLIARGLYLQTVTYNFLKEQGDNRIVRTQTLPATRGTVSDRNGAVLALSAPTESLFAVPKEMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLHGEDGAEVVLRDRQGNIVDSLDSPRNKAPKNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPVSFEKQAVAPQGKRIFKESTAREVRNLMVSVTEPGGTGTAGAVDGFDVGAKTGTARKFVNGRYADNKHIATFIGFAPAKNPRVIVAVTIDEPTAHGYYGGVVAGPPFKKIMGGSLNILGISPTKPLTAAAVKTPS

SEQ ID NO: 41524 - DNA, 1746 bp, Neisseria meningitidis; identical to SEQ ID NO: 41522

SEQ ID NO: 41525 - protein, 581 aa, Neisseria meningitidis; identical to SEQ ID NO: 41523

SEQ ID NO: 41526 - DNA, 1548 bp, Neisseria gonorrhoeae
gtgcgtttcaatcatttcataatggtaacgattattatatatgtgatttcccctgcaaacaagccggtccgccgccccggcgttcccacttatccggctttgccttataattgctttttttatgtaacagattcacctatgaatttccccaaaacagcggcctccctgctgctgcttctcgcctccctcgccgcacacgcgctcgataccggccgcattccgcaaaacgaaatcgctgtatatgtccaagagcttgacagcggaaaagtcatcattgaccaccgtgccggcatacccgtcaatcccgcgtccacgatgaagctcgttaccgcgtttgccgccttcaaaaccttcggcagcaattaccgctgggcgaccgagtttaaaagcaacggtacggtaaacgacggcacgcttgacggaaacctgtattgggcgggcagcggcgaccccgttttcaatcaggaaaacctgcttgccgtccaacgccagttgcgcgacaaaggcatccgcaatatcacggggcgcctgatgctcgaccacagcctgtggggcgaagtcggcagtcccgaccattttgaagccgacagcggttcgccgtttatgacgcccccaaatccgactatgctgtctgccggtatggttatggtgcgcgccgaacgcaatgccgccggcagtaccgacatcctcaccgatccgcctttgccgcatatttttgcccaaaacaacttgaaaattaccgcctcccaagctgcctgcccttcggtcaaaaaactgatgcgcgcatctttttcgggcaatacgctgaaattgcgcggcaatattcccgaaagctgtttgggcaagcctgtcggtgtccggatgttcgcgcttgacgaactgatccgccaaagttttaccaaccgctggctgctcggcggcggacggatttcagacggcatcggcatagccgacacaccggaaggcgcgcagacgcttgccgttgcacactccaaaccgatgaaggaaattttgacggacatgaacaagcgttcggacaatctgattgcgcgttccgtcttcctcaaactcggcggcgacggcaaactgcccgccgtttccgaacaggcggcgtctgccgtccggcgagaacttgccgtatcgggcatcgatgttgcggatttggttttggaaaacggttcgggtctgtccagaaaagaaagggtaacggcgagaatgatggcgcaaatgttggaaacggcttatttcagcccgtttgcacaagatttcatcgacacgctgcccatcgccggcacagacgggactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgcccgacttggacaacttcgttgccaaaaacatcatctccggcggcgacggctggctggatgcgaaactgatgtgcaaagaacgccgcgcctga

SEQ ID NO: 41527 - protein, 515 aa, Neisseria gonorrhoeae
VRFNHFIMVTIIIYVISPANKPVRRPGVPTYPALPYNCFFYVTDSPMNFPKTAASLLLLLASLAAHALDTGRIPQNEIAVYVQELDSGKVIIDHRAGIPVNPASTMKLVTAFAAFKTFGSNYRWATEFKSNGTVNDGTLDGNLYWAGSGDPVFNQENLLAVQRQLRDKGIRNITGRLMLDHSLWGEVGSPDHFEADSGSPFMTPPNPTMLSAGMVMVRAERNAAGSTDILTDPPLPHIFAQNNLKITASQAACPSVKKLMRASFSGNTLKLRGNIPESCLGKPVGVRMFALDELIRQSFTNRWLLGGGRISDGIGIADTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVAKNIISGGDGWLDAKLMCKERRA

SEQ ID NO: 41528 - DNA, 1548 bp, Neisseria meningitidis
gtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgataccggccgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctatattgggcgggcagcggcgaccccgttttcaatcaggaaaacctgcttgatgctcaaaaacagttgcgcgaacaaggcatactcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccggcagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggtatcggcatagccgacacgccggaaggcgcgcagacacttgccgttgcacacgccaaaccgatgaaagaaattttgacggacatgaacaagcgttcggacaatctaattgcgcgttccgtcttcctcaaactcggcggcgacggcaaactgcccgccgtttccgaacaggcggcgtctgccgtccggcgcgaacttgccgtatcgggcatcgatgttgcggatttggttttggaaaacggttcgggcctgtccagaaaagaaagggtaacggcgagaatgatggcgcaaatgttggaaacggcttatttcagcccgtttgcacaagatttcatcgacacgctacccatcgccggcacagacggaactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgccagacttggacaacttcgttgccaacaacatcatctccggcggcgatggctggctggatgcgaaactgatgtgcaaagaacgccgagcctga

SEQ ID NO: 41529 - protein, 515 aa, Neisseria meningitidis
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLDAQKQLREQGILNITGHLMLDHSLWGEVGSPDDFEADSGSPFMTPPNPTMLSAGMVMVRAERNAAGSTDILTDPPLPHIFAQNNLKITASQAACPSIKKLMRASFSDNTLKLRGNIPESCLGKPVGVRMFALDELIRQSFTNHWLLGGGRISDGIGIADTPEGAQTLAVAHAKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 41530 - DNA, 1548 bp, Neisseria meningitidis
gtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgatacaggtcgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctgtattgggcgggcagcggcgaccccgttttcaatcaggaaaacctgcttgccgtccaacgccagttgcgcgaacaaggcatacgcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccgacagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggcatcggcatatccgacacgccggaaggcgcgcagacgcttgccgttgcacactcaaagccgatgaaggaaattttgacggacatgaacaagcgttcggacaatctaattgcgcgttccgtcttcctcaaactcggcggcgacggcaaactgcccgccgtttccgaacaggcagcgtctgccgtccggcgtgaacttgccgtgtcgggcatcgatgttgcggatttggttttggaaaacggttcaggtctgtccagaaaagaaagggtaacggcgagaatgatggcgcaaatgttggaaacggcttatttcagcccgtttgcacaagatttcatcgatacgctgcccatcgccggcacagacgggactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgcccgacttggacaacttcgttgccaacaacatcatctccggcggcgatggctggctggatgcgaaactgatgtgcaaagaacgccgagcctga

SEQ ID NO: 41531 - protein, 515 aa, Neisseria meningitidis
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLAVQRQLREQGIRNITGHLMLDHSLWGEVGSPDDFEADSGSPFMTPPNPTMLSAGMVMVRAERNAADSTDILTDPPLPHIFAQNNLKITASQAACPSIKKLMRASFSDNTLKLRGNIPESCLGKPVGVRMFALDELIRQSFTNHWLLGGGRISDGIGISDTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 41532 - DNA, 1172 bp, Neisseria gonorrhoeae
atgccgtctgaaatgccgtctgaaacgtggcaggcggaggttcggacggcattgggtttatttcaacgggcggatgccgaccgcatcgcgtactttatccaacaattcgcgcgcttctttgcgcgctttttgcgcgcctgcctgcaaaatctcttcgatttgcgaaggattagaggtcaatgcgttgtagcgttcgcgcagttctgccaattcggcgttgattttcgccgccgaaagttttttcgcctcgccccaagccaagccgtcggcaagcatttgcgtaaattccgccgtttcagacggcgtggagaaggctttatagatttcaaacaaagggctttcgtcgggctgtttcggctcgcccggctctttcatgttggtaatgattttgttgaccgatttttgggtttttttgtcgttttcccaaagcggaatggtattgccgtaggatttggacattttgcgtccgtccaaaccgaccaagagttcgacgttttcgtcgattttcacttcgggcagggtgaagagttcttggaaaccgtgggtgaagcggccggcaatgtcgcgcgccatttcgacgtgttggatttggtcgcgcccgacggggacttcgttggcgttgaacatcaaaatgtcggcagtcatcagaatcggataactgaacaaacccatttccacaccgaaatcggggtcttcctgcccgttttccgcattggcttgaacggcggctttgtaggcgtgggcgcggttcatcaaacccttggcggtgatgcaggtcagaatccagttcaactccatcacttcgggaatgtcgctttggcggtagaaggtggtgcgctcggggtcgagtccgcaggcaagccaagtggcggcaacggcttgggtggattggtgaatcatctcctgctcgtggcatttgatgatgccgtggtaatcggcgaggaagaggaaggattcggtatcggggttttgcgccgcgcggacggcggggcggatggcgccgacgtagttgcccagatgcggggtgccggtggtggttacgccggtcagaactcgttttttgctcataaaaatgtccttacggcagcaatgccgtctgaaagggaaaagatgcgccgattatacccgatttgccacatacatccagccgacaacagacttttccatattaa

SEQ ID NO: 41533 - protein, 390 aa, Neisseria gonorrhoeae
MPSEMPSETWQAEVRTALGLFQRADADRIAYFIQQFARFFARFLRACLQNLFDLRRIRGQCVVAFAQFCQFGVDFRRRKFFRLAPSQAVGKHLRKFRRFRRRGEGFIDFKQRAFVGLFRLARLFHVGNDFVDRFLGFFVVFPKRNGIAVGFGHFASVQTDQEFDVFVDFHFGQGEEFLETVGEAAGNVARHFDVLDLVAPDGDFVGVEHQNVGSHQNRITEQTHFHTEIGVFLPVFRIGLNGGFVGVGAVHQTLGGDAGQNPVQLHHFGNVALAVEGGALGVESAGKPSGGNGLGGLVNHLLLVAFDDAVVIGEEEEGFGIGVLRRADGGADGADVVAQMRGAGGGYAGQNSFFAHKNVLTAAMPSEREKDAPIIPDLPHTSSRQQTFPY

SEQ ID NO: 41534 - DNA, 1160 bp, Neisseria meningitidis
atgccgtctgaaacgcggcaggcggaggttcggacggcatcgggttcatttcaacgggcggatgccgaccgcatcggtactttgtccaataattcgcgtgcttctttacgcgctttcgccgcgcctgcctgcaaaatctcttcgatttgcgaagggtcggcggtcagctcgttgtagcgttcgcgcggttcggcgagttcggcgttgattttcgccgccaaaagttttttggcttcaccccacgccaagccgtcggcaagcattttcgtaaattccaccgtttcagacggcgtggagaaggctttgtagatttcaaacaatgggctttcgtcgggctgtttcggctcgcccggctctttcatattggtgatgattttgttgaccgatttttgggtttttttgtcgttttcccaaagcggaatggtgttgccgtaggatttggacattttgcgtccgtccaaaccgaccaagagttcgacgttttcatcgattttcacttcgggcagggtgaagagttcccggaagcggtggttgaagcggccggcgatgtcgcgcgccatttcgacgtgttggatttggtcgcgcccgacgggcacttcgttggcgttgaacatcagaatatcggcagtcatcagaatcggataactgaacaaacccatttccacaccgaaatcagggtcttcctgcccgttttctgcatttgcctgcacggcggctttgtaggcatgggcgcggttcatcaaacccttggcagtgatgcaggtcagaatccagttcaattccatcacttcgggagtgtcgctttggcggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcgaggttttgcgccgcgcggacggcggggcggatggcgccgacgtagttgcccagatgcgggatgccggtggtggttacgccggtcagaactcgttttttgctcataaaaatgtccttgcggcatcaatgccgtctgaaagggaaaaagatgtgccgattatacccgatttgccacctacatccagccgacaacagacttttccatattaa

SEQ ID NO: 41535 - protein, 385 aa, Neisseria meningitidis
  misc_feature (26)..(26): Xaa can be any naturally occurring amino acid
MPSETRQAEVRTASGSFQRADADRIXYFVQFACFFTRFRRACLQNLFDLRRVGGQLVVAFARFGEFGVDFRRQKFFGFTPRQAVGKHFRKFHRFRRRGEGFVDFKQWAFVGLFRLARLFHIGDDFVDRFLGFFVVFPKRNGVAVGFGHFASVQTDQEFDVFIDFHFGQGEEFPEAVVEAAGDVARHFDVLDLVAPDGHFVGVEHQNIGSHQNRITEQTHFHTEIRVFLPVFCICLHGGFVGMGAVHQTLGSDAGQNPVQFHHFGSVALAVEGGALGVESAGKPSGGNGLGGLVNHLRLVAFDDTVVIGEEEEGFGIEVLRRADGGADGADVVAQMRDAGGGYAGQNSFFAHKNVLAASMPSEREKDVPIIPDLPPTSSRQQTFPY

SEQ ID NO: 41536 - DNA, 1137 bp, Neisseria meningitidis
gaggttcggacggcattgggtttatttcaacgggcggataccgaccgcatcacgtactttgcccaataattcgcgtgcttctttacgcgctttttgcgcgcctgcctgcaaaatctcttcgatttgcgaagggtcggcggtcagctcgttgtagcgttcgcgcggttcggcgagttcggcgttgattttcgccgccaaaagtttttttgcctcgccccaagccaagccgtcggcaagcattttcgtaaattctgccgtttcagacggcgtggagaaagctttgtagatttcaaacagagggctttcgtcgggcttcttcggctcgcccggctctttcatattggtgatgattttgttgaccgatttttgggtttttttgtcgttttcccaaagcggaatggtgttgccgtaggatttggacattttgcgtccgtccaaaccaaccaagagttcgacgttttcgtcgattttcacttcgggcagtgtgaagagttcccggaagcggtggttgaagcggccggcaatatcgcgtgccatttcaacgtgttggatttggtcgcgaccgactggaacttcatgggcattgaacatgagaatgtcggcagtcatgaggatagggtagctgtacaaacccatttccacgccgaaatcggggtcttcctgcccgttttccgcatttgcctgcacggcggctttgtaggcgtgggcgcggttcatcaaacccttggcggtgatgcaggtcagaatccagttcaattccatcacttcgggaatgtcgctttgacggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcagggttttgcgccgcgcggacggcggggcggatagcaccgacgtagttgcccagatgcgggatgccggtggtggttacgccggtcagaactcgttttttgctcataaaaatgtccttgcggcatcaatgccgtctgaaagggaaaaagatgcgccgattatacccgatttgccacctacatccagccgacaacagacttttccatattaa

SEQ ID NO: 41537 - protein, 377 aa, Neisseria meningitidis
EVRTALGLFQRADTDRITYFAQFACFFTRFLRACLQNLFDLRRVGGQLVVAFARFGEFGVDFRRQKFFCLAPSQAVGKHFRKFCRFRRRGESFVDFKQRAFVGLLRLARLFHIGDDFVDRFLGFFVVFPKRNGVAVGFGHFASVQTNQEFDVFVDFHFGQCEEFPEAVVEAAGNIACHFNVLDLVATDWNFMGIEHENVGSHEDRVAVQTHFHAEIGVFLPVFRICLHGGFVGVGAVHQTLGGDAGQNPVQFHHFGNVALTVEGGALGVESAGKPSGGNGLGGLVNHLRLVAFDDTVVIGEEEEGFGIRVLRRADGGADSTDVVAQMRDAGGGYAGQNSFFAHKNVLAASMPSEREKDAPIIPDLPPTSSRQQTFPY

SEQ ID NO: 41538 - DNA, 810 bp, Neisseria meningitidis
  misc_feature (709)..(709): n is a, c, g, or t
atgcccgatttttcgatgtccaatttggccgttgccttttccatcacattggctgccggtttgtttaccgtattakgyagtggcttggtgatgttttccaaaacgcccaatccgcgtgtgttgtcgtttggtttggcgtttgccggcggtgcgatggtatatgtttccctgacggagattttcagtaagtccagcgaggcgttcgctgaaatttatgataaagaccacgcgtttgcggcggcgaccatggcatttttggccgggatgggcggcattgcgctgattgaccgtctggtgccgaacccgcatgaaactttagacgcgcaagacccgtcgtttcaagaaagcaaacgccgccatatcgcgcgagtcggcatgatggcggcgtttgcgattactgcgcacaatttccccgaaggcttggcgacgttttttgccacattggaaaatccagcagtcgggatgcctttggccttggcgattgccatccataatattccggagggcatttccatcgccgcgccggtttattttgccacccgcagccgtaagaaaacggtgtgggcgtgtctgctatccggcttggccgagccgttgggggcggctttgggctatttggttttgcagccgtttttgtcgcctgccgtgtttggttcggtattcggcgtgatagccggtgtgatggtgtttttggcgttggacgagctgntgccggctgccaaacgctattcagacggccatgaaaccgtttacggcctgacaacgggtatggcggtgattgccgtcagcctggtattgttccatttttaa

SEQ ID NO: 41539 - protein, 269 aa, Neisseria meningitidis
  misc_feature (26)..(26): Xaa can be any naturally occurring amino acid
  misc_feature (237)..(237): Xaa can be any naturally occurring amino acid
MPDFSMSNLAVAFSITLAAGLFTVLXSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELXPAAKRYSDGHETVYGLTTGMAVIAVSLVLFHF

SEQ ID NO: 41540 - DNA, 810 bp, Neisseria meningitidis
atgcccgatttttcgatgtccaatttggccgttgccttttccattacgttggctgccggtttgtttaccgtattaggcagcggcttggtgatgttttccaaaacgcccaatccgcgcgtgttgtcgtttggtttggcatttgccggcggtgcgatggtgtatgtttccctgacggagattttcagtaagtccagcgaggcgttcgctgaaatttatgataaagaccacgcgtttgcggcggcgaccatggcatttttggcagggatgggcggcattgcgctgattgaccgtctggtgccgaacccgcatgaaactttagacgcgcaagacccgtcgtttcaagaaagcaaacgccgccatatcgcgcgagtcggcatgatggcggcgtttgcgattactgcgcacaatttccccgaaggcttggcgacgttttttgccacattggaaaatccagcagtcgggatgcctttggccttggcgattgccatccataatattccggagggcatttccatcgccgcgccggtttattttgccacccgcagccgtaagaaaacggtgtgggcgtgtctgctatccggcttggccgagccgttgggggcggctttgggctatttggttttgcagccgtttttgtcgcctgccgtgtttggttcggtattcggcgtgatagccggtgtgatggtgtttttggcgttggacgagctgctgccggctgccaaacgctattcagacggccatgaaaccgtttacggcctgacaatgggcatggcggtgattgccgtcagcctggtattgttccatttttaa

SEQ ID NO: 41541 - protein, 269 aa, Neisseria meningitidis
MPDFSMSNLAVAFSITLAAGLFTVLGSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELLPAAKRYSDGHETVYGLTMGMAVIAVSLVLFHF

SEQ ID NO: 41542 - DNA, 1089 bp, Neisseria gonorrhoeae
atgccgtccgaacccgaacggcggcatggcaatactgccctacccttcccgatagccgcacgcccaacggtcggtttttccggcaagcctttcaagataaccggcaagtgtgtcgtattgcgccgccgcattgtccaagcggttgatttcacgccgcgcctgttcgccgtcgggcatttcgccgatgtaccagcctatgtgtttgcgtgcgatgcgcacaccgacggtctcaccataaaacgcgtgcatggcgcggatgtggttcaaaatggcggctctgcattctgccaaactcaaggcaggcggtaaaacgccgtgttcggcataatgcttcaaatcgcggaaaaaccacggcctgccttgcgcgccgcgccctatcatgatgccgtcggcggcggtttgtttgaggacggcggcggctttttgcggcgaagtgatgtcgccgttgacccaggccgggatgttcagacggcttttggtctcggcgatgagttcgtaacgcgcctcgcctttgtacatttgcgtgcgcgcgcgcccgtgaacggcaagggcggcaatgccgcaatcttcggcgattttggcgacggcgggcaggttttgatcgtcgtcgtgccaacccaaacgggttttgagggtaacgggtacgcccgccgccttgaccaccgcctccaaaatggcggcaaccagcggctcgtcctgcatcagcgcgctaccggcttggacgttgcacactttcttggcggggcagcccatattgatgtcgatgacctgcgccccgagtccgacgttgtaacgcgccgcatccgccatctgttcggggtcgctgccggcaatctgcacggcaacgatgccgccttcatcggcaaaatcactgcggtgcagggtttttccggtattcctgagcgtcggatcgctggccagcatttcgcacaccgcccaacctgcgccaaacgcccgacagaggcggcggaagggtttgtcggcaatgcccgccatcggcgcaagtgcgatggggttgtcgataaaataaccgccgatgtgcataatgggcccgcgtttcaaaaaagtgcgccattgtacattttttaa

SEQ ID NO: 41543 - protein, 361 aa, Neisseria gonorrhoeae
MPSEPERRHGNTALPFPIAARPTVGFSGKPFKITGKCVVLRRRIVQAVDFTPRLFAVGHFADVPAYVFACDAHTDGLTIKRVHGADVVQNGGSAFCQTQGRRNAVFGIMLQIAEKPRPALRAAPYHDAVGGGLFEDGGGFLRRSDVAVDPGRDVQTAFGLGDEFVTRLAFVHLRARAPVNGKGGNAAIFGDFGDGGQVLIVVVPTQTGFEGNGYARRLDHRLQNGGNQRLVLHQRATGLDVAHFLGGAAHIDVDDLRPESDVVTRRIRHLFGVAAGNLHGNDAAFIGKITAVQGFSGIPERRIAGQHFAHRPTCAKRPTEAAEGFVGNARHRRKCDGVVDKITADVHNGPAFQKSAPLYIF

SEQ ID NO: 41544 - DNA, 1083 bp, Neisseria meningitidis
ttgcactttcaaaggataatcaagtgttcagaaggcatttgggcggtaggcgcacgcccaactgtcggttttttcggcaagtctttcaagataacctgcaagcatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgtatggcgcggatgtggttcaaaatagcggcggcgcattctgccaaactcaaggcaggcggcaaaacaccgtgttcggcataatgtttcaaatcgcggaagaaccacggcctgccttgcgcgccgcgccctatcataatgccgtcggcggcggtttgtttgaggacggcttgggctttttgcggcgaagtaatgtcgccgttgacccagaccgggatgttcagacggcatttggtttcggcgatgagttcgtaacgcgcttcgcctttgtacatttgcgtacgcgtgcgtccgtggacggcaagggcggcgatgccgcaatcttcggcgattttggcgatgacgggcaggttttgatggtcgtcgtgccaacccaaacgggttttgagggtaacgggtacgcctgccgcacggacgacggcttccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaa

SEQ ID NO: 41545 - protein, 360 aa, Neisseria meningitidis; identical to SEQ ID NO: 12152

SEQ ID NO: 41546 - DNA, 1083 bp, Neisseria meningitidis
ttgcactttcaaaggataatcaagtgttcagaaggcatttgggcggtaggcgcacgcccaactgtcggttttttcggcaagtctttcaagataacctgcaaacatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgcatggctcggatgtggttcaaaatagtggcggtacattctgccaaactcaaggcaggcggtaaaacaccgtgttcggcgtaatgtttcaaatcgcggaagaaccacggtctgccttgcgcgccgcgccctatcataatgccgtctgcggcggtttgtttgaggacggcttgggctttttgcggcgaggtaatgtcgccgttgacccagaccgggatgttcagacggcatttggtttcggcaatcaggtcgtaagccgcttcgcctttgtacatttgcgtgcgcgtgcgtccgtggacggcaagggcggcaatgccgcaatcttcggcgattttggcgatgacgggcaggttttgatggtcgtcgtgccaacccaaacgggttttgagggtaacgggtacgcccgccgctttgaccaccgcctccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaa

SEQ ID NO: 41547 - protein, 359 aa, Neisseria meningitidis; identical to SEQ ID NO: 24420

SEQ ID NO: 41548 - DNA, 1578 bp, Neisseria gonorrhoeae
atggcaacacaggtaggcggtgcaaattcggatgaggcaagcccctgctttcctatttctgaggtggaattggtgggtgaagaaacggctaaattccggtttgcgctcaaccatgccttgtgccaaacacattttgtttccggcaagtgtctgcatgcgggcgacattaatcaaatcatgtccttagcacaaaatgctttgatcggcaggggatataccacgacccgtatcttggctgcgccacaggatttgaatagtggcaagcttcaattaaccctgatgccgggctatctgcgctccatacgaatcgatcggtccaacgatgatcaaacccatgcaggacgtattgcagcattccaaaacaaatttcccacccgctcgaacgatctgttgaatctgcgtgatttggaacaaggactggaaaatctcaaatgtctcccgactgcggaagccgatctccaaatcgttcccgtagagagagaaccaaaccaaagtgatgtcgtggtgcaatggcggtaacgtctgctgccctactgtgtgagtgtggggatggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 41549 - protein, 525 aa, Neisseria gonorrhoeae
  misc_feature (173)..(173): Xaa can be any naturally occurring amino acid
MATQVGGANSDEASPCFPISEVELVGEETAKFRFALNHALCQTHFVSGKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRXRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 41550 - DNA, 1644 bp, Neisseria meningitidis
atgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttaytttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 41551 - protein, 547 aa, Neisseria meningitidis
  misc_feature (411)..(411): Xaa can be any naturally occurring amino acid
MQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFXLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 41552 - DNA, 1644 bp, Neisseria meningitidis
  misc_feature (1339)..(1339): n is a, c, g, or t
  misc_feature (1515)..(1515): n is a, c, g, or t
  misc_feature (1527)..(1527): n is a, c, g, or t
atgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggcgcgcaaattttcttttcttccttctgtgctcatgaaagaaacagcttttaaaactgggatgtgtttaggttccaataatttgagcaggctacaaaaagccgcgcaacagatactgattgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggtgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacaggtttcataaaacttcagtcggaatgaaattatggacacgccaaacctataaatacatcgacgatgccgaaatcgaagtgcaacgccgccgctctgcaggctgggaagccgaattgcgccaccgtgcttacctcaaccgttggcagcttgacggcaagttgtcttacaaacgcgggaccggcatgcgccaaagtatgcccgcacctgaagaaaacggcggcggtactattccaggcacatcccgtatgaaaatcataaccgccggattggatgcagcggccccgtttatgttgggcaaacagcagtttttctacgcaaccgccattcaagctcaatggaacaaaacgcctttggttgcccaagacaagttgtctatcggcagccgctacaccgttngcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggnttcagaggaggncataaagtaggcggtatgtttgcttatgatctgtttgccggcaagccgcttcataaacccaaaggctttcagacgaccaacaccgtttacggcttcaacttgaattacagtttctaa

SEQ ID NO: 41553 - protein, 547 aa, Neisseria meningitidis
  misc_feature (447)..(447): Xaa can be any naturally occurring amino acid
MQRQQHIDAELLTDANVRFEQPLEKNNYVLSEDETPCTRVNYISLDDKTARKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLVHKTDLTDATGTETESGSRSYSVHYSVPVKKWLFSFNHNGHRYHEATEGYSVNYDYNGKQYQSSLAAERMLWRNRFHKTSVGMKLWTRQTYKYIDDAEIEVQRRRSAGWEAELRHRAYLNRWQLDGKLSYKRGTGMRQSMPAPEENGGGTIPGTSRMKIITAGLDAAAPFMLGKQQFFYATAIQAQWNKTPLVAQDKLSIGSRYTVXGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 41554 - DNA, 1311 bp, Neisseria gonorrhoeae
atgatgcagcacaatcgtttcttcgcggtcggggccggtggagacgatggcgaccggcgcgccgcagacttcttcaatccgtttcaaatatgctttggcattggcaggcaatgcgtcgtagcttttcacgccgacagtcgattcgcgccagccgggcatggtttcgtaaatcggtttgcaggtttccaccgcatccgaaccgcaaggcaggatgtcggttttgccgccgcctggcaattcgtagccgacgcagatattgatggtttcaacgccgtccattacatcgagtttggtaatgcacataccggaaatgccgttgatttggatggagcgtttcagggcggcggcatcaaaccagccgcagcggcgcgcgcggccggttaccgaaccgaattcgtgtccgcgctccgccaaacctgcgcctacttcgtcgaacaattcggtcgggaacgggcccgaaccgacgcgcgtggtataggctttgacgatgcccaaaacataatccagcatttgaggacctacgcccgcgcctgccgaagccgcgccggcgagacagttggacgaggtaacgaaggggtaagtgccgtagtcgatgtccaacaacgcaccttgcgcgccttcaaacagcagtttttcgccgtttttgtttttttcgttcaacacgcgggacacgtcggcaatcatcggcgcaatgcgcggcgcgactttttcgataaccgccatcacgtcttccgctttaaccggtccggcgttatgcaggtattggagttggacgttgtaataggcaaggacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggaaacgacaacgcccgaaccgatgaagcaatccaatccttcgtgcaggataccgctcggaatcaggcgcaaaatggtttttttgccgccgacgaccaaggtatggcccgcattgtggccgccttggaagcgcacgacgctgccggcttcttccgccagccagtcaacgattttacctttaccctcgtcgccccactgtgcgccgattactacaacatttttagccatagccatataacctatcgatattaa

SEQ ID NO: 41555 - protein, 436 aa, Neisseria gonorrhoeae; identical to SEQ ID NO: 36275

SEQ ID NO: 41556 - DNA, 1310 bp, Neisseria meningitidis
atgatgcagcacaatcgtttcttctcggtcggggccggtggagacgatggcgaccggcgcgccgcagacttcttcaatccgtttcaaatatgctttggcgttttcgggcaatgcgccgtagtccttcacgccgaaagtggattcgcgccagccgggcatggtttcgtaaatcggcttgcaggtttccaccgcatcggaaccgcaaggcaggatgtcggttttgccgccgtcgggcaattcatagccgacgcagatattgatggtttcaacgccgtccattacatcgagtttagtaatacacataccggaaatgccgttgatttggatggagcgtttcagggcggcggcatcaaaccagccgcagcggcgtgcgcgtccggttaccgaaccgaattcgtgtccgcgttctgccaaacctacgcctacttcgtcgaacaattcggtcgggaacgggcccgaaccgacgcgcgtggtataggctttgacgatgcccaaaacataatccagcatttgaggacctacgcccgcgcctgccgaagctgcgcccgccagacagttggacgaggtaacgaagggataagtgccgtagtcgatgtccaacaacgcaccttgcgcgccttcaaacagcagtttttcgccgtttttgtttttctcgttcaacacgcgggacacgtcggtaatcatcggcgcaatgcgcggcgcgactttttcgataaccgccatcacgtcttccgctttaaccggctcggcattgtgcagatgttgcagttggacattgtaataggcaaggacggcatccagtttttcacgcagtttytcaggatgcagcaaatcggcggcgcgaatggcgcggcgtgccactttgtcttcgtaggcagggccgatgccgcggccggtcgtgccgattttgcctttgccgcgcgatcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccaaactttcatgcaggatgccgctcggaatcaggcgcaaaatggtttttttgccgccgacaaccaaggtatggcccgcattgtggccgccttggaagcgcaccacgccgccggcttcttccgccagccagtcaacgattttacctttaccctcgtcgccccactgtgcgccgattastacaacatttttagccatagccatataacctatcgatattaa

SEQ ID NO: 41557 - protein, 436 aa, Neisseria meningitidis
  misc_feature (273)..(273): Xaa can be any naturally occurring amino acid
  misc_feature (308)..(308): Xaa can be any naturally occurring amino acid
  misc_feature (423)..(423): Xaa can be any naturally occurring amino acid
MMQHNRFFSVGAGGDDGDRRAADFFNPFQICFGVFGQCAVVLHAESGFAPAGHGFVNRLAGFHRIGTARQDVGFAAVGQFIADADIDGFNAVHYIEFSNTHTGNAVDLDGAFQGGGIKPAAAACASGYRTEFVSAFCQTYAYFVEQFGRERARTDARGIGFDDAQNIIQHLRTYARACRSCARQTVGRGNEGISAVVDVQQRTLRAFKQQFFAVFVFLVQHAGHVGNHRRNARRDFFDNRHHVFRFNRLGIVQMLQLDIVIGKDGIQFFTQFXRMQQIGGANGAACHFVFVGRADAAAGRADFAFAAXIFAGLVERDVVRQDQRAGRRDFQTAFDVFHACRVQLVDFAQQGFGGDDNARTDEAVQTFMQDAARNQAQNGFFAADNQGMARIVAALEAHHAAGFFRQPVNDFTFTLVAPLCADXYNIFSHSHITYRY

SEQ ID NO: 41558 - DNA, 1310 bp, Neisseria meningitidis
atgatgcagcacaatcgtttcttcgcggtcggggccggtggagacgatggcgaccggcgcaccgcagacttcttcaatccgtttcaaatatgctttggcattggcaggtaatgcgtcgtagcttttcacgccgaaagtggattcgctccaaccgggcatggtttcgtaaatcggcttgcaggcttctaccgcatcagagccgcaaggcaggatgtcggttttgccgccgtcgggcaattcgtagccgacgcagatattgatggtttcaacgccgtccattacatcgagtttggtaatacacataccggaaatgccgttgatttggatggagcgtttcagggcggcggcatcaaaccagccgcagcggcgtgcgcgtccggttaccgaaccgaattcgtgtccgcgttctgccaaacctgctccgacttcgtcgaacaattcggtcgggaacgggcccgaaccgacgcgcgtggtataggctttgacgatgcccaaaacataatccagcatttgagggcctacgcccgcgcctgccgaagccgcgccggcgaggcagttggacgaagtaacgaaggggtaagtgccgtagtcgatgtccaacaacgcaccttgcgcgccttcaaacagcagtttttcgccgtttttgtttttttcgttcaacacgcgggacacgtcggtaatcatcggcgtaatgcgcggcgcgactttttcgataaccgccatcacgtcttccgctttcaccgactcggcattgtgcagatgttgcagttggacgttgtaataagcaaagacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttctcgggcttggtcgagcgcgatgtgataaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccagactttcatgcaggatgccgctcggaatcaggcgcaaaatggtttttttgccgccgacaaccaaggtatgacccgcattgtggccgccttggaagcgcaccacgcctccggcttcttccgccagccagtcaacgattttacctttaccctcgtcgccccactgtgcgccgattactacaacatttttagccatagccatataaccttcgatattaa

SEQ ID NO: 41559 - protein, 435 aa, Neisseria meningitidis; identical to SEQ ID NO: 24422
  misc_feature (433)..(433): Xaa can be any naturally occurring amino acid

SEQ ID NO: 41560 - DNA, 339 bp, Neisseria meningitidis
atgaaatatatcgtatcaatctctctggctatgggattggctgcctgttcgtttgggggatttaaaccaaatccgtgggacgccgcgtcattttgggaattgaaaaattacgccaatccctatccgggatcagcctcggcggcacttgaccaatatccatcgaaagcaagacgaaggcaactgaaagacatgcaagagtgcggctatgacccaatagacggcggaaagtctgaagcagatgcctgcctgaggaaaaaaggctggtgtcgtaagggtttcgacccttatcccgaaaacaaaaaatacgaatggcctcgagaagaaggaaaaacaaaatga

SEQ ID NO: 41561 - protein, 112 aa, Neisseria meningitidis
MKYIVSISLAMGLAACSFGGFKPNPWDAASFWELKNYANPYPGSASAALDQYPSKARRRQLKDMQECGYDPIDGGKSEADACLRKKGWCRKGFDPYPENKKYEWPREEGKTK

SEQ ID NO: 41562 - DNA, 378 bp, Neisseria gonorrhoeae
atgaaaaaaccgaccgataccctacccgtcaatctgcaacgccgccgcctgctgtgtgccgccggcgcgctgttgatcagcccgctggcgcacgccggcgcgcaacgtgaagaaacgcttgccgacgatgtggcttccgtgatgaggagttctgtcggcagcgtcaatccgccgaggctggtgttcgacaatccgaaagagggcgaacgttggttgtccgcgatgtcggcacgtttggcaagattcgtccccgacgagggggagcggcgcaggctgctggtcaatatccaatacgaaagcagccgggccggtttggatacgcagattgtgttggggctgattgaagtggaaagcgggtaccgagctcgaatcatatca

SEQ ID NO: 41563 - protein, 126 aa, Neisseria gonorrhoeae
MKKPTDTLPVNLQRRRLLCAAGALLISPLAHAGAQREETLADDVASVMRSSVGSVNPPRLVFDNPKEGERWLSAMSARLARFVPDEGERRRLLVNIQYESSRAGLDTQIVLGLIEVESGYRARIIS

SEQ ID NO: 41564 - DNA, 624 bp, Neillia sinensis
atgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttktggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttga

SEQ ID NO: 41565 - protein, 207 aa, Neisseria meningitidis
  misc_feature (139)..(139): Xaa can be any naturally occurring amino acid
MRKPTDTLPVNLQRRRLLCAAGALLLSPLAHAGAQREETLADDVASVMRSSVGSVNPPRLVFDNPKEGERWLSAMSARLARFVPEEEERRRLLVNIQYESSRAGLDTQIVLGLIEVESAFRQYAISGVGARGLMQVMPXWKNYIGKPAHNLFDIRTNLRYGCTILRHYRNLEKGNIVRALARFNGSLGSNKYPNAVLGAWRNRWQWR

SEQ ID NO: 41566 - DNA, 624 bp, Neisseria meningitidis
atgaaaaaaccgaccgataccctacccgtcaatctgcaacgccgccgcctattgtgtgctgccggcgcgctgttgctcagcccgctggcacaagccggcgcgcaacgtgaagaaacgcttgccgacgatgtggcttccgtgatgaggagctctgtcggcagcataaatccgccgaggctggtgttcgacaatccgaaagagggcgagcgttggctgtccgcgatgtctgctcggttggcaaggttcgtccccgatgaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcactcgcccgttttaacggtagcctcggcagcaataaatatccgaacgccgttttgggcgcgtggcgcaaccgctggcagtggcgttga

SEQ ID NO: 41567 - protein, 207 aa, Neisseria meningitidis; identical to SEQ ID NO: 24423

SEQ ID NO: 41568 - DNA, 500 bp, Neisseria gonorrhoeae
atgagaaaagccgtctaagccggtataaacaaaataaactcattgggctatttgtcgcaggtgtaactgcaagaacagcggcagagttggtaggcattaataaaaataccgcagcctatgattttcatcgtttacgatgactgatttatcaaaacggtccgcatttagaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagtattgtttatacggattgttatcgtagctatgatgtattagatgtgagcgaatttagccattttagcttcgctgaaacttcgttttcgtatcaatcacagcacacattttgccgaacgacaaaaccatattaa

SEQ ID NO: 41569 - protein, 165 aa, Neisseria gonorrhoeae
  misc_feature (2)..(2): Xaa can be any naturally occurring amino acid
MXKSRLSRYKQNKLIGLFVAGVTARTAAELVGINKNTAAYDFHRLRLIYQNGPHLEMFDGEVEADESYFGGQRKGKRGRGAAGKVAVFGLLKRNGKVYTVTVPNTQTATLFPIIREQVKPDSIVYTDCYRSYDVLDVSEFSHFSFAETSFSYQSQHTFCRTTKPY

SEQ ID NO: 41570 - DNA, 501 bp, Neisseria meningitidis
atgagaaaaagtcgtctaagccagtataaacaaamtaaactcattgaactgtttgtcacaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaa

SEQ ID NO: 41571 - protein, 166 aa, Neisseria meningitidis
  misc_feature (12)..(12): Xaa can be any naturally occurring amino acid
MRKSRLSQYKQXKLIELFVTGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIFYTDCYRSYDVLDVREFSHFSFAETSFSYQSQHTFCRTTKPY

SEQ ID NO: 41572 - DNA, 501 bp, Neisseria meningitidis
atgagaaaaagtcgtctaagccagtataaacaaaataaactcattgagctatttgtcgcaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattgtttatacggattgttatcgtagctatgatgtattagatgtgcgcgaatttagccattttagcttcgctgaaacttcgttttcgtatcaatcacagcacacattttgccgaacgacaaaaccatattaa

SEQ ID NO: 41573 - protein, 166 aa, Neisseria meningitidis; identical to SEQ ID NO: 24424

SEQ ID NO: 41574 - DNA, 327 bp, Neisseria gonorrhoeae
atgcgtaaaaccgtacttatcctgaccatctccgccgcccttttgtcgggctgcacatgggaaacttatcaagacggcagcggcaaaaccgccgtccgtgcaaaatgttccaccggcacgccgctgtgttggcaagacgggcgcggctcgaaaaaggtggactgcgacgagtacggtggcgaacgccgggccgtgttgcgcaaccaaaagcgggggaagcccgcgacgaggagagccgcaacgctggggaaaccgagtttccgggcgagggacgggggggggcgggtgaacagggcagaaacgggggaggggaagcgatcggcgagg

SEQ ID NO: 41575 - protein, 109 aa, Neisseria gonorrhoeae
MRKTVLILTISAALLSGCTWETYQDGSGKTAVRAKCSTGTPLCWQDGRGSKKVDCDEYGGERRAVLRNQKRGKPATRRAATLGKPSFRARDGGGRVNRAETGEGKRSAR

SEQ ID NO: 41576 - DNA, 273 bp, Neisseria meningitidis
atgcgtaaaaccttcctcttcctgaccgctgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaatcaaaccggcaacaacgccgacgaagagcatcgccaacactggcaaaaaccaaagtttcaaaaccgataa

SEQ ID NO: 41577 - protein, 90 aa, Neisseria meningitidis
MRKTFLFLTAAAALLSGCAWETYQDGNGKTAVRQKYPAGTPVYYQDGSYSKNMNYNQYRPERHAVLPNQTGNNADEEHRQHWQKPKFQNR

SEQ ID NO: 41578 - DNA, 273 bp, Neisseria meningitidis
atgcgtaaaaccttccttatcctgatgactgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaaccaaaccggcaacaacgccgacgaagagcatcgccaacactggcaaaagcccaaatttcaaaaccgataa

SEQ ID NO: 41579 - protein, 90 aa, Neisseria meningitidis
MRKTFLILMTAAALLSGCAWETYQDGNGKTAVRQKYPAGTPVYYQDGSYSKNMNYNQYRPERHAVLPNQTGNNADEEHRQHWQKPKFQNR

SEQ ID NO: 41580 - DNA, 285 bp, Neisseria gonorrhoeae
atgaaaaaactgttattggccgccgttgtttccctaaatgccgcaaccgcatttgccggcgactctgccgagcgtcagatttacggcgatccccattttgaacaaaaccgcacaaaagccgtgaaaatgttggaacagcgcggttatcaggtttacgatgtcgatgccgacgactactggggcaaacctgttttggaagtggaagcctataaagacggccgcgaatacgacatcgtgttgtcttaccccgacctgaaaatcatcaaagagcagctcgatcgctga

SEQ ID NO: 41581 - protein, 94 aa, Neisseria gonorrhoeae
MKKLLLAAVVSLNAATAFAGDSAERQIYGDPHFEQNRTKAVKMLEQRGYQVYDVDADDYWGKPVLEVEAYKDGREYDIVLSYPDLKIIKEQLDR

SEQ ID NO: 41582 - DNA, 285 bp, Neisseria meningitidis
atgaaaaaactgttattggctgccgttgtttctctgagtgccgctgccgcatttgccggcgactctgccgagcgtcagatttacggcgatccccattttgaacaaaaccgcacaaaagctgtgaaaatgttggagcagcgcggttatcaggtttacgatgtcgatgccgacgaccattggggtaagcctgtgctggaagtggaagcctataaagacggccgcgaatacgacatcgtgttgtcttaccccgacctgaaaatcatcaaagagcagctcgatcgctga

SEQ ID NO: 41583 - protein, 94 aa, Neisseria meningitidis
MKKLLLAAVVSLSAAAAFAGDSAERQIYGDPHFEQNRTKAVKMLEQRGYQVYDVDADDHWGKPVLEVEAYKDGREYDIVLSYPDLKIIKEQLDR

SEQ ID NO: 41584 - DNA, 285 bp, Neisseria meningitidis
atgaaaaaactgttattggtcgccgttgtttccttgagtgccgcaaccgcatttgccggcgactctgccgagcgtcagatttacggcgatccctattttgaacaaaaccgcacaaaagccgtgaaaatgttggaacagcgcggttatcaggttcacgatgtcgatgccgacgaccattggggcaaacctgttttggaagtggaagcctataaagacggccgcgaatacgacattgtgttgtcttaccccgacctgaaaatcatcaaagagcagctcgatcgctga

SEQ ID NO: 41585 - protein, 94 aa, Neisseria meningitidis
MKKLLLVAVVSLSAATAFAGDSAERQIYGDPYFEQNRTKAVKMLEQRGYQVHDVDADDHWGKPVLEVEAYKDGREYDIVLSYPDLKIIKEQLDR

SEQ ID NO: 41586 - DNA, 495 bp, Neisseria gonorrhoeae
atgaaaaagaacatattggaattttgggtcggactgttcgtcttgatcggcgcggcggcggttgcctttctcgctttccgcgtggcgggcggcgcggcgttcggcggttcggacaaaacttacgccgtttatgccgatttcggcgacatcggcggtttgaaggtcaatgcccccgtcaaatccgcaggcgtattggtcgggcgcgtcggcgctatcgggcttgacccgaaatcctatcaggcgagggtgcgccttgatttggacggcaagtatcagttcagcagtgacgtttccgcgcaaatcctgacttcgggacttttgggcgaacagtacatcgggctgcagcagggcggcgatacggaaaaccttgctgccggcgacaccatctccgtaaccagttctgcaatggttctggaaaacctgatcggtaaattcatgaccagcttcgccgagaaaaacgctgagggcggcaatgcggaaaaagccgcagaataa

SEQ ID NO: 41587 - protein, 164 aa, Neisseria gonorrhoeae
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNAEGGNAEKAAE

SEQ ID NO: 41588 - DNA, 495 bp, Neisseria meningitidis
atgaagaagaacatattggaattttgggtcggactgttcgtcctgattggcgcggcggcggttgcctttctcgctttccgcgtggccggcggtgcggcgttcggcggttcggacaaaacttacgccgtttatgccgatttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcgggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 41589 - protein, 164 aa, Neisseria meningitidis
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNADGGNAEKAAE

SEQ ID NO: 41590 - DNA, 495 bp, Neisseria meningitidis
atgaaaaagaacatattggaattttgggtcggactgttcgtcctgattggcgcggcggcggttgcctttctcgctttccgcgtggccggcggtgcggcgttcggcggttcggacaaaacttacgccgtttatgccgatttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcgggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 41591 - protein, 164 aa, Neisseria meningitidis; identical to SEQ ID NO: 41589

SEQ ID NO: 41592 - DNA, 591 bp, Neisseria gonorrhoeae
gtgaaaaaatcctccttcatcagcgcattgggcatcggtattttgagcatcggcatggcatttgcctccccggccgacgcagtgggacaaatccgccaaaacgccacacaggttttgaccatcctcaaaagcggcgacgcggcttctgcacgcccaaaagccgaagcctatgcggttccctatttcgatttccaacgtatgaccgcattggcggtcggcaacccttggcgtaccgcgtccgacgcgcaaaaacaagcgttggccaaagaatttcaaaccctgctgatccgcacctattccggcacgatgctgaaattcaaaaacgcgaccgtcaacgtcaaagacaatcccatcgtcaataagggcggcaaggaaatcgtcgtccgtgccgaagtcggcatccccggtcagaagcccgtcaatatggactttaccacctaccaaagcggcggcaaataccgtacctacaacgtcgccatcgaaggcacgagcctggttaccgtgtaccgcaaccaattcggcgaaatcatcaaagccaaaggcatcgacgggctgattgccgagttgaaagccaaaaacggcggcaaataa

SEQ ID NO: 41593 - protein, 196 aa, Neisseria gonorrhoeae
VKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 41594 - DNA, 591 bp, Neisseria meningitidis
atgaaaaaatcctccctcatcagcgcattgggcatcggtattttgagcatcggcatggcatttgccgcccctgccgacgcggtaagccaaatccgtcaaaacgccactcaagtattgagcatcttaaaaaacggcgatgccaacaccgctcgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaagccaaaaacggcggcaaataa

SEQ ID NO: 41595 - protein, 196 aa, Neisseria meningitidis
MKKSSLISALGIGILSIGMAFAAPADAVSQIRQNATQVLSILKNGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGGK

SEQ ID NO: 41596 - DNA, 591 bp, Neisseria meningitidis
atgaaaaaatcctccttcatcagcgcattgggcatcggtattttgagcatcggcatggcatttgccgcccctgccgacgcggtaaaccaaatccgtcaaaacgccactcaagtattgagcatcttaaaaagcggtgatgccaacaccgcccgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaggctaaaaacggcagcaagtaa

SEQ ID NO: 41597 - protein, 196 aa, Neisseria meningitidis
MKKSSFISALGIGILSIGMAFAAPADAVNQIRQNATQVLSILKSGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGSK

SEQ ID NO: 41598 - DNA, 834 bp, Neisseria gonorrhoeae
atgaaaaaaaccgcctacgccatcctcctgctgatcgggttcgcttccgcccctgcatttgcagaaacccgccccgccgacccttatgaaggctacaaccgcgccgtttccaaattcaacgaccaagccgaccgctacattttcgcccctgccgcgcgcggctaccgcaaagttacgccgaaacccgtccgcgccggcgtgtccaatttttttaacaacctgcgcgacgtggtcagtttcggcagcaatatcttgcgtttggacatcaaacgcgcaagcgaagacctcgtccgcgtcggcatcaataccaccttcggtttgggcgggctcattgatattgccggcgcgggcggcgttcccgacaataaaaacactttgggcgacacgtttgcctcgtggggctggaaaaacagcaattatttcgtgttgcccgtcttaggcccgtccaccgtccgcgacgcgctcggcacgggcattacctctgtttatccgcccaagaatatcgttttccatacccctgccggacgctggggcacgactgccgctgccgccgtcagtacgcgcgaaggcctcctcgatttgaccgacagtctggacgaagccgccatcgacaaatacagctacacgcgcgacctctatatgaaagtccgcgcacggcagaccggtgcaacacctgccgaaggtacggaagataacatcgacatcgacatcgacgaattggtcgaaagtgccgaaaccggcgcggcagagcccgccgttcacgaagattccgtatccgaaacacaggcagaagcagcaggggaagccgaaacgcaacctggaacacaaccctaa

SEQ ID NO: 41599 - protein, 277 aa, Neisseria gonorrhoeae
MKKTAYAILLLIGFASAPAFAETRPADPYEGYNRAVSKFNDQADRYIFAPAARGYRKVTPKPVRAGVSNFFNNLRDVVSFGSNILRLDIKRASEDLVRVGINTTFGLGGLIDIAGAGGVPDNKNTLGDTFASWGWKNSNYFVLPVLGPSTVRDALGTGITSVYPPKNIVFHTPAGRWGTTAAAAVSTREGLLDLTDSLDEAAIDKYSYTRDLYMKVRARQTGATPAEGTEDNIDIDIDELVESAETGAAEPAVHEDSVSETQAEAAGEAETQPGTQP

SEQ ID NO: 41600 - DNA, 828 bp, Neisseria meningitidis
atgaaaaaaaccgcctatgccttcctcctgctgatcgggttcgcttccgcccctgcatttgccgaaacccgccccgccgacccttatgaaggctacaaccgcgccgttttcaaattcaacgaccaagccgaccgctacattttcgcccctgccgcgcgcggctaccgcaaagttgcgccgaaacccgtccgcgccggcgtgtccaatttttttaacaacctgtgcgacgtggtcagcttcggcagcaatatcttgcgcttggacatcaaacgcgcaagcgaagaccttgtccgcgtcggcatcaacaccactttcggtttgggcgggcttatcgacatcgccggcgcgggcggcattcccgacaataaaaacaccttgggcgacacgtttgcctcgtggggatggaaaaacagcaattatttcgtgttgcccgtcttagggccgtccaccgtccgcgacgcgctcggcacgggtattacctccgtttattcgcccaagaatatcgtcttccgcacccctgtcggacgctggggcacgactgccgtatccgccgtcagtacgcgcgaaggcctgctcgatttgaccgacagtctggacgaagccgccatcgacaaatacagctacacgcgcgacctctatatgaaagtccgtgcgcggcagaccggtgcaacacctgccgaaggtacggaagataacatcgacatcgacgaattggtcgaaagtgccgaaaccggcgcggcggaaactgccgttcaagaagattccgtatccgaaacacaggcagaagcagcaggggaagccgaaacgcaacctggaacacaaccttaa

SEQ ID NO: 41601 - protein, 275 aa, Neisseria meningitidis
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQP

SEQ ID NO: 41602 - DNA, 840 bp, Neisseria meningitidis
atgaaaaaaaccgcctatgccttcctcctgctgatcgggttcgcttccgcccctgcatttgccgaaacccgccccgccgacccttatgaaggctacaaccgcgccgttttcaaattcaacgaccaagccgaccgctacattttcgcccctgccgcgcgcggctaccgcaaagttgcgccgaaacccgtccgcgccggcgtgtccaatttttttaacaacctgtgcgacgtggtcagcttcggcagcaatatcttgcgcttagacatcaaacgcgcaagcgaagaccttgtccgcgtcggtatcaacaccactttcggtttgggcgggcttatcgacatcgccggcgcgggcggcattcccgacaataaaaacaccttgggcgacacgtttgcttcgtggggatggaaaaacagcaattatttcgtgttgcccgtcttagggccgtccaccgtccgcgacgcgctcggcacgggtattacctccgtttattcgcccaagaatatcgtcttccgcacccctgtcggacgctggggcacgactgccgtatccgccgtcagtacgcgcgaaggcctgctcgatttgaccgacagtctggacgaagccgccatcgacaaatacagctacacgcgcgacctctatatgaaagtccgtgcgcggcagaccggtgcaacacctgccgaaggtacggaagataacatcgacatcgacgaattggtcgaaagtgccgaaaccggcgcggcggaaactgccgttcaagaagattccgtatccgaaacacaggcagaagcagcaggggaagccgaaacgcaacctggaacacaacctggaacacaaccttaa

SEQ ID NO: 41603 - protein, 279 aa, Neisseria meningitidis
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQPGTQP

SEQ ID NO: 41604 - DNA, 729 bp, Neisseria gonorrhoeae
atgaaaaaatgtattttgggcattttgaccgcgtgtgccgccatgcctgcatttgccgacagaatcagcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcggagatgaggcaatccgatgcagaaaattcgattgatgtatcggttggacggataaagaaacggatacggagcttggcttccgtctctgtttttctctgcccgattttccatgcatcgggtttcagacggcattggagtgtcagtcgtgttctgccgattcgtaggcttcgacgattttttgcaccagaggatgccggacaacgtcttcgccggtgaaggtatggaaatacagtcctgccacgccgtgcagtttctcacgtgcgtctttcaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 41605 - protein, 240 aa, Neisseria gonorrhoeae
MKKCILGILTACAAMPAFADRISDLEARLAQLEHRVAVLESGGNTVKIDLFGSNSTMYVCSVTPFQKTFEASDRNEGVARQKVRQACNRETSAMFCGDEAIRCRKFDCIGWTDKETDTELGFRLCFSLPDFPCIGFQTALECQSCSADSASTIFCTRGCRTTSSPVKVWKYSPATPCSFSRASFNPDLMFLGRSIWLVSPVMTAFAPKPMRVRNIFICSGVVFCASSRMMYAPLSVLPRI

SEQ ID NO: 41606 - DNA, 735 bp, Neisseria meningitidis
atgaaaaaatgtattttgggcattttgaccgcgtgtgccgccatgcctgcatttgccgacagaatcggcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggatacggagcttggcttccgtatctgtttttctctgcctgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgttgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 41607 - protein, 244 aa, Neisseria meningitidis
  misc_feature (108)..(108): Xaa can be any naturally occurring amino acid
  misc_feature (153)..(153): Xaa can be any naturally occurring amino acid
MKKCILGILTACAAMPAFADRIGDLEARLAQLEHRVAVLESGGNTVKIDLFGSNSTMYVCSVTPFQKTFEASDRNEGVARQKVRQACNRETSAMFCEDEAIRCRKFDXCIGWTDKETDTDTELGFRICFSLPDFPCIGFQTALECQSCSADSXASTIFCTKGCRTTSSPVKVWKYSPSTLCSFSRASFNPDLMFLGRSIWLVSPVMTAFAPKPMRVRNIFICSGVVFCASSRMMYAPLSVLPRI

SEQ ID NO: 41608 - DNA, 729 bp, Neisseria meningitidis
atgaaaaaatgtattttgggcattttgaccgcgtgtgccgccatgcctgcatttgccgacagaatcggcgatttggaagcacgtctggcgcagttggaacaccgtgtcgccgtattggaaagcggcagcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggagcttggcttccgtatctgtttttctctgcccgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgccgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 41609 - protein, 240 aa, Neisseria meningitidis
MKKCILGILTACAAMPAFADRIGDLEARLAQLEHRVAVLESGSNTVKIDLFGSNSTMYVCSVTPFQKTFEASDRNEGVARQKVRQACNRETSAMFCEDEAIRCRKFDCIGWTDKETDTELGFRICFSLPDFPCIGFQTALECQSCSADSASTIFCTKGCRTTSSPVKVWKYSPSTPCSFSRASFNPDLMFLGRSIWLVSPVMTAFAPKPMRVRNIFICSGVVFCASSRMMYAPLSVLPRI

SEQ ID NO: 41610 - DNA, 495 bp, Neisseria gonorrhoeae; identical to SEQ ID NO: 40818

SEQ ID NO: 41611 - protein, 164 aa, Neisseria gonorrhoeae; identical to SEQ ID NO: 40819

SEQ ID NO: 41612 - DNA, 494 bp, Neisseria meningitidis
atgaaaaaaaccctgttggcaattgttgccgtttccgccttaagtgctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataa

SEQ ID NO: 41613 - protein, 164 aa, Neisseria meningitidis
  misc_feature (16)..(16): Xaa can be any naturally occurring amino acid
MKKTLLAIVAVSALSXCRQAEEGPPPLPRQISDRSVGHYCSMNLTEHNGPKAQIFLNGKPDQPVWFSTIKQMFGYTKLPEEPKGIRVIYVTDMGNVTDWTNPNADTEWMDAKKAFYVIDSGFIGGMGAEDALPFGNKEQAEKFAKDKGGKVVGFDDMPDTYIFK

SEQ ID NO: 41614 - DNA, 495 bp, Neisseria meningitidis; identical to SEQ ID NO: 40820

SEQ ID NO: 41615 - protein, 164 aa, Neisseria meningitidis; identical to SEQ ID NO: 40821

SEQ ID NO: 41616 - DNA, 1131 bp, Neisseria gonorrhoeae
atggtcaaacatctgccactcgccgtcctgactgctttgctgcttgcagcgtgcggcggttcggacaaaccgcctgccgaaaaaccggcaccggcggaaaaccaaaacgtattgaaaatttataactggtcggaatacgtcgatccggaaaccgttgccgattttgaaaagaaaaacggcatcaaggttacttatgatgtgtacgacagtgatgaaacgctggaaagcaaggtgctgaccggaaaatccggttacgacattgtcgcgccgtccaatgcgtttgtgggcaggcagattaaggcaggtgcgtatcagaaaatcgataagtcgatgattcccaattataaacatctcaaccctgaaatgatgaggctgatggacggggtcgatcccgaccacgaatacgccgtgccgttttattgggggacaaataccttcgccatcaataccgaacgcgtgaaaaaggctttgggtacggacaagctgccggacaaccagtgggatttggtgttcaaccccgaatacacgttcaaactcaaacaatgcggcatcagctatttggacagcgcggcggaaatttatcccatggtgttgaactatttgggcaaaaacccgaacagcagcaatacggaagacatcagggaggcaaccgccctgctcaagaaaaaccgccccaatatcaaacgctttacttcgtccggctttatcgatgatttggcgcgcggcgatacctgcgtaacaatcggtttcggcggagatttgaacatcgccaaacgccgtgccgaagaagcgggcggcaaggaaaaaatccgcgtgatgatgccgaaagagggcgtggggatttgggtggattctttcgtgattccgaaagatgcgaaaaacgtcgccaacgcgcacaaatacatcaacgacttcctcgatccggaagtgtcggcgaaaaacggcaatttcgttacctacgcgccttcgagcaagccggcgcgcgatttgatggaggacgaatttaaaaacgacaatacgattttcccgagcggggaagatttgaaaaacagctttatcatggtgcctatccggccggcggcattgaagtttatggtgcgccagtggcaggatgtgaaggcggggaaataa

SEQ ID NO: 41617 - protein, 376 aa, Neisseria gonorrhoeae
MVKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSMIPNYKHLNPEMMRLMDGVDPDHEYAVPFYWGTNTFAINTERVKKALGTDKLPDNQWDLVFNPEYTFKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARDLMEDEFKNDNTIFPSGEDLKNSFIMVPIRPAALKFMVRQWQDVKAGK

SEQ ID NO: 41618 - DNA, 1131 bp, Neisseria meningitidis
atgaccaaacatctgcccctggccgtcctgactgctttgctgcttgcagcgtgcggcggttcggacaaaccgcctgccgaaaaaccggcaccggcggaaaaccaaaacgtattgaaaatttacaactggtcggaatatgtcgatccggaaaccgttgccgattttgaaaagaaaaacggcatcaaggttacttatgatgtgtacgacagcgatgaaacgctggaaagcaaggtgctgacaggcaagtccggttacgacattgtcgcgccgtccaatgcgtttgtgggcaggcagattaaggcaggtgcgtatcagaaaatcgataagtcgctgattcccaattataaacacctcaaccccgaaatgatgaggctgatggacggggtcgatcccggccacgaatacgccgtgccgttttattgggggacaaataccttcgccatcaataccgaacgcgtgaaaaaggctttgggtacggacaagctgccggacaaccagtgggatttggtgttcgaccccgaatacacgtccaaactcaagcaatgcggcatcagctatttggacagcgcggcggaaatctatcctatggtgttgaactatttgggtaaaaacccgaacagcagcaatacggaagacatcagggaggcaaccgccctactcaagaaaaaccgccccaatatcaaacgctttacttcgtccggctttatcgatgatttggcgcgcggcgatacctgcgtaacaatcggtttcggcggcgatttgaacatcgccaaacgccgtgccgaagaagcgggcggcaaggaaaaaatccgcgtgatgatgcccaaagagggcgtggggatttgggtggattctttcgtgattccgaaagatgcgaaaaacgtcgccaacgcgcacaaatacatcaacgacttcctcgacccggaagtgtcggcgaaaaacggcaatttcgttacttacgcgccttcgagcaagcctgcgcgtgagctgatggaagacgaatttaaaaacgacaatacgattttcccaaccgaggaggatttgaaaaacagctttatcatggtgcctatccagccggcggcattgaagtttatggtgcgccagtggcaggatgtgaaggcggggaaataa

SEQ ID NO: 41619 - protein, 376 aa, Neisseria meningitidis
MTKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 41620 - DNA, 1131 bp, Neisseria meningitidis
atgaccaaacatctgcccctggccgtcctgactgctttgctgcttgcagcgtgcggcggttcggacaaaccgcctgccgaaaaaccggcgccggcggaaaaccgaaacgtattgaaaatttacaactggtcggaatacgtcgatccggaaaccgttgccgattttgaaaagaaaaacggcatcaaggttacttatgatgtgtacgacagcgatgaaacgctggaaagcaaggtgctgaccggaaaatctggttacgacattgtcgcgccgtccaatgcgtttgtgggcaggcagattaaggcaggtgcgtatcagaaaatcgataagtcgctgattcccaattataaacacctcaaccccgaaatgatgaggctgatggacggggtcgatcccggccacgaatacgccgtgccgttttattgggggacaaataccttcgccatcaataccgaacgcgtgaaaaaggctttgggtacggacaagctgccggacaaccagtgggatttggtgttcgaccccgaatacacgtccaaactcaagcaatgcggcatcagctatttggacagcgcggcggaaatctatcctatggtgttgaactatttgggtaaaaacccgaacagcagcaatacggaagacatcagggaggcaaccgccctactcaagaaaaaccgccccaatatcaaacgctttacttcgtccggctttatcgatgatttggcgcgcggcgatacctgcgtaacaatcggtttcggcggcgatttgaacatcgccaaacgccgtgccgaagaagcgggcggcaaggaaaaaatccgcgtgatgatgcccaaagagggcgtggggatttgggtggattctttcgtgattccgaaagatgcgaaaaacgtcgccaacgcgcacaaatacatcaacgacttcctcgacccggaagtgtcggcgaaaaacggcaatttcgttacttacgcgccttcgagcaagcctgcgcgtgagctgatggaagacgaatttaaaaacgacaatacgattttcccaaccgaggaggatttgaaaaacagctttatcatggtgcctatccagccggcggcattgaagtttatggtgcgccagtggcaggatgtgaaggcggggaaataa

SEQ ID NO: 41621 - protein, 376 aa, Neisseria meningitidis
MTKHLPLAVLTALLLAACGGSDKPPAEKPAPAENRNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 41622 - DNA, 1326 bp, Neisseria gonorrhoeae; identical to SEQ ID NO: 38761

SEQ ID NO: 41623 - protein, 441 aa, Neisseria gonorrhoeae; identical to SEQ ID NO: 38762

SEQ ID NO: 41624 - DNA, 1326 bp, Neisseria meningitidis; identical to SEQ ID NO: 38757

SEQ ID NO: 41625 - protein, 441 aa, Neisseria meningitidis; identical to SEQ ID NO: 38758

SEQ ID NO: 41626 - DNA, 1326 bp, Neisseria meningitidis; identical to SEQ ID NO: 38763

SEQ ID NO: 41627 - protein, 441 aa, Neisseria meningitidis; identical to SEQ ID NO: 38764

SEQ ID NO: 41628 - DNA, 624 bp, Neisseria gonorrhoeae
ccgatgcagctggttaccgaaaaaggtaaggaaaacatgattcaacgcggcacatacaactaccaataccgcagcaaccgtcccgtcaaagacggcagctacctcgttaccgccgaatatcagcctactttccggtcaaaaaacaaagcaggctggaaacaggctggcatcaaagaaatgcctgacgcaagctattgcgaacaaacccgtatgttcggtaaaaacattgtcaacgtgggacacgaaagcgcggacaccgccatcatcaccaaaccggtcggacaaaacttggaaatcgtcccgctggacaatcccgccgacattcacgtgggctaacgcttcaaagtccgcgttctgttccgtggcgaaccgctgcccaatgccaccgttaccgctacatttgacggcttcgacaccagcgaccgcagcaaaacgcacaaaaccgaagcccaagccttctccgacaccaccgacggcgaaggcgaagtggacatcatccccttgcgccaaggcttttggaaagcgagtgtcgaatacaaagccgatttccccgatcaaagcctgtgccgaaaacaggcgaactacacaactttaaccttccaaatcgcccattctcaccattaa

SEQ ID NO: 41629 - protein, 207 aa, Neisseria gonorrhoeae
  misc_feature (112)..(112): Xaa can be any naturally occurring amino acid
PMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPADIHVGXRFKVRVLFRGEPLPNATVTATFDGFDTSDRSKTHKTEAQAFSDTTDGEGEVDIIPLRQGFWKASVEYKADFPDQSLCRKQANYTTLTFQIAHSHH

SEQ ID NO: 41630 - DNA, 807 bp, Neisseria meningitidis
atgaagaaaacattgacactgctctccgtttccgccctatttgccacatccgcccacgcccaccgmgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaawacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaarccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaawmccgaagcacaggctttctccgacagcacagacgacaaaggcgaagtggacatcatcmccttgcgccaaggcttctggaaagccaatgtcgaacacaaaaccgacttccccgatcaaagcgtgtgccaaaaacaggcgaactactcgactttaaccttccaaatcggtcattcgcaccattaa

SEQ ID NO: 41631 - protein, 268 aa, Neisseria meningitidis
  misc_feature (109)..(109): Xaa can be any naturally occurring amino acid
  misc_feature (208)..(209): Xaa can be any naturally occurring amino acid
  misc_feature (228)..(228): Xaa can be any naturally occurring amino acid
MKKTLTLLSVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKXKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHXXEAQAFSDSTDDKGEVDIIXLRQGFWKANVEHKTDFPDQSVCQKQANYSTLTFQIGHSHH

SEQ ID NO: 41632 - DNA, 807 bp, Neisseria meningitidis
tgaaagaaaacattgacactgctcgccgtttccgccctatttgccgcatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaacaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaagccgacttccccgatcaaagcgtgtgccaaaaacaggcgaactactcgactttaaccttccaaatcggccattcgcaccattaa

SEQ ID NO: 41633 - protein, 267 aa, Neisseria meningitidis
KKTLTLLAVSALFAASAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKQMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKADFPDQSVCQKQANYSTLTFQIGHSHH

SEQ ID NO: 41634 - DNA, 807 bp, Neisseria gonorrhoeae
atgaagaaaacattgacactgctcgccgtttccgcactatttgccacatccgcacacccccaccgcgtctgggtcgaaaccgcccacacgcacggcggcgaataccttaaagccgacttgggctacggcgaattccccgaactcgaacccatcgccaaagaccgcctgcacatcttcagcaaaccgatgcagctggttaccgaaaaaggtaaggaaaacatgattcaacgcggcacatacaactaccaataccgcagcaaccgtcccgtcaaagacggcagctacctcgttaccgccgaatatcagcctactttccggtcaaaaaacaaagcaggctggaaacaggctggcatcaaagaaatgcctgacgcaagctattgcgaacaaacccgtatgttcggtaaaaacattgtcaacgtgggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgctacatttgacggcttcgacaccagcgaccgcagcaaaacgcacaaaaccgaagcccaagccttctccgacaccaccgacggcaaaggcgaagtggacatcatccccttgcgccaaggcttttggaaagcgagtgtcgaatacaaagccgatttccccgatcaaagcctgtgccaaaaacaggcgaactacacaactttaaccttccaaatcggccattctcaccattaa

SEQ ID NO: 41635 - protein, 268 aa, Neisseria meningitidis
MKKTLTLLAVSALFATSAHPHRVWVETAHTHGGEYLKADLGYGEFPELEPIAKDRLHIFSKPMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDTTDGKGEVDIIPLRQGFWKASVEYKADFPDQSLCQKQANYTTLTFQIGHSHH

SEQ ID NO: 41636 - DNA, 807 bp, Neisseria meningitidis
atgaagaaaacattgacactgctcgccgtttccgccctatttgccacatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaaaccgacttccccgatcaaagcgtgtgccaaaaacaggcgaactactcgactttaaccttccaaatcggtcattcgcaccattaa

SEQ ID NO: 41637 - protein, 268 aa, Neisseria meningitidis
MKKTLTLLAVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKTDFPDQSVCQKQANYSTLTFQIGHSHH

SEQ ID NO: 41638 - DNA, 807 bp, Neisseria meningitidis; identical to SEQ ID NO: 41632

SEQ ID NO: 41639 - protein, 267 aa, Neisseria gonorrhoeae; identical to SEQ ID NO: 41633

SEQ ID NO: 41640 - DNA, 489 bp, Neisseria gonorrhoeae
atgaaaaaataccttatccctctttccattgcggcagtcctttccgggtgccagtctatttatgtgcccacattgacggaaatccccgtgaatcccatcaataccgtcaaaacggaagcacctgcaaaaggttttcgcctcgccccttcgcattgggcggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcggtagacagccagcgcggcgaaatcaatacggaacagtccaagctgtatatcgagaatgccttgcgcggctggcagcagcgttggaaaaatatggatgccaaacccgataatcccgcatttaccaactttttgatggaagtgatgaagatgcagcccttgaaatga

SEQ ID NO: 41641 - protein, 162 aa, Neisseria meningitidis
MKKYLIPLSIAAVLSGCQSIYVPTLTEIPVNPINTVKTEAPAKGFRLAPSHWADVAKISDEATRLGYQVGIGKMTKVQAAQYLNNFRKRLVGRNAVDDSMYEIYLRSAVDSQRGEINTEQSKLYIENALRGWQQRWKNMDAKPDNPAFTNFLMEVMKMQPLK

SEQ ID NO: 41642 - DNA, 489 bp, Neisseria meningitidis
atgaaaaaataccttatccctctttccattgcggcagttctttccggctgccagtctatttatgtgcccacattgacggaaatccccgtgaatcctatcaataccgtcaaaacggaagcacctgcaaaaggtttccgccttgcctcttcgcattggacggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcgatagacagccagcggggcgcaatcaatacggaacagtccaagctgtatatccagaatgccttgcgcggctggcagcagcgttggaaaaatatggatgtcaaacccaacaaccccgcatttaccaactttttgatggaagtgatgaagatgcagcccttgaaatga

SEQ ID NO: 41643 - protein, 162 aa, Neisseria meningitidis
MKKYLIPLSIAAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 41644 - DNA, 489 bp, Neisseria meningitidis
atgaaaaaataccttatccctctttccattgtggcagttctttccggctgccagtctatttatgtgcccacattgacggaaatccccgtgaatcctatcaataccgtcaaaacggaagcacctgcaaaaggtttccgccttgcctcttcgcattggacggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcgatagacagccagcggggcgcaatcaatacggaacagtccaagctgtatatccagaatgccttgcgcggctggcagcagcgttggaaaaatatggatgtcaaacccaacaaccccgcatttaccaactttttgatggaagtgatgaagatgcagcccttgaaatga

SEQ ID NO: 41645 - protein, 162 aa, Neisseria gonorrhoeae
MKKYLIPLSIVAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 41646 - DNA, 1092 bp, Neisseria gonorrhoeae
atggaaaagagaaaaatactgccgctggcaatttgtttggcggctttgtctgcctgtacggcgatggaggcccgcacaccccgggcaaatgaagcccaagccccccgcgcggatgaaatgaaaaaagaaagccgccccgcgtttgacgcggcagccgtaccggtatccgacagcgggtttgccgccaatgcaaatgtccgccgttttgtggacgatgaagtcgggaaaggggatttttcccaggcggaatggcaggatttttttgacaaagcggcttacaaggcggacatcgtcaagattatgcaccgaccctccacatcgcgtccgtggtatgtgttccgcacgggaaattcgggcagggcgaaatttcacggcgcgcgcaggttttatgcggaaaaccgcgcggttatcgatgatgtggcgcaaaaatacggcgtgcctgccgagcttatcgtggcgattatcgggattgaaacgaattacggcaaaaatacgggcagtttccgtgtggcggacgcattggcgactttaggctttgattatccccgccgcgccgggtttttccaaaaagaattggtcgagcttttaaagctggcaaaagaagaaggcggtgatgttttcgcctttaagggcagctatgcgggtgcaatgggtatgccgcaatttatgccttcgagctaccggaaatgggcggtggattatgacggggacggacatcgggatatatggggcaacgtcggtgatgtcgcggcatcggttgccaattatatgaagcagcacggttggcgcacgggcggtaaaatgttggtgtcggcgacgttggcgccgggtgcggatgttcaggcaatcattggcgaaaaaaccgccctgacgcggacggtggcggatttgaaggcgtacggcatcatccccggggaaacgctcgcagatgatgaaaaggcggttttgttcaaactggaaaccgcacccggcgtgtttgaatattatttgggcttgaacaatttttatacggtatggcagtacaaccacagccggatgtatgtaacggcggtcagggacattgccaattcgctcggcggcccgggattgtaa

SEQ ID NO: 41647 - protein, 363 aa, Neisseria meningitidis
MEKRKILPLAICLAALSACTAMEARTPRANEAQAPRADEMKKESRPAFDAAAVPVSDSGFAANANVRRFVDDEVGKGDFSQAEWQDFFDKAAYKADIVKIMHRPSTSRPWYVFRTGNSGRAKFHGARRFYAENRAVIDDVAQKYGVPAELIVAIIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGETLADDEKAVLFKLETAPGVFEYYLGLNNFYTVWQYNHSRMYVTAVRDIANSLGGPGL

SEQ ID NO: 41648 - DNA, 1110 bp, Neisseria meningitidis
atgaaaaagagaaaaatactgccgctggcaatttgtttggcggctttgtctgcctgtacggcgatggaggcacgcccaccccgggcaaatgaagcccaagccccccgcgcggttgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaacgtcggcgatgtcgcggcatcggttgccaattatatgaagcagcacggttggcgcacgggcgggaaaatgctggtgtctgcaacattggcgccgggtgcggatgttcaggcaatcattggcgaaaaaaccgccctgacgcggacggtggcggatttgaaggcgtacggcatcatccccggcgaagagcttgcagatgatgaaaaggcggttttgttcaaactggaaaccgcaccgggcgtgtttgaatattatttgggcttgaacaatttttatacggtatggcagtacaaccacagccggatgtatgtaacggcggtcagggacattgccaattcgcttggcggcccgggattgtaa

SEQ ID NO: 41649 - protein, 369 aa, Neisseria meningitidis
MKKRKILPLAICLAALSACTAMEARPPRANEAQAPRAVEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 41650 - DNA, 1110 bp, Neisseria meningitidis
atgaaaaacagaaaaatactgccgctggcaatttgtttggcggctttgtctgcctgtacggcgatggaggcacgcccgccccgggcaaatgaagcccaagccccccgcgcggatgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaatgttggcgatgtcgcggcatcgattgccaattatatgaagcagcacggttggcgcacgggcgggaaaatactggtgtctgcaacattggcgccgggtgcggatgttcaggcaatcattggcgaaaaaaccgccctgacgcggacggtggcggatttgaaggcgtacggcatcatccccggcgaagagcttgccgatgatgaaaaggcggttttgttcaaactggaaaccgcacccggcgtgtttgaatattatttgggcttgaacaatttttatacggtatggcagtacaatcacagtcggatgtatgtaacggcggtcagggacattgccaattcgcttggcggcccgggattgtaa

SEQ ID NO: 41651 - protein, 369 aa, Neisseria gonorrhoeae
MKNRKILPLAICLAALSACTAMEARPPRANEAQAPRADEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASIANYMKQHGWRTGGKILVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 41652 - DNA, 372 bp, Neisseria gonorrhoeae
atgaagcggcaggctttcttcaaaccgatggcgtgtgcggcatttctgtccgccgtttcgctgcgcctccccgtattgggcgcgtgttacgcaatattgtccctctatgcgtttgcactttacggcatcgacaaacggcgtgccgtgcggggaaaacgccgcattcccgaacaccgcctgctcctgcctgccttgttcggcggttggacgggcgcatacttgggtagtaggatgttcaggcataaaacggcgaaaaagcgttttgttgtgctgttccgtctgactgtttcgggcaatgtcctggcgacctgcatcctgattgattatttcgttccgcccgaactttttgtaaaactcgggcaacatctctga

SEQ ID NO: 41653 - protein, 123 aa, Neisseria meningitidis
MKRQAFFKPMACAAFLSAVSLRLPVLGACYAILSLYAFALYGIDKRRAVRGKRRIPEHRLLLPALFGGWTGAYLGSRMFRHKTAKKRFVVLFRLTVSGNVLATCILIDYFVPPELFVKLGQHL

SEQ ID NO: 41654 - DNA, 476 bp, Neisseria meningitidis
atgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctgatttttgttaatccactatattattttgtcccgcctgaatttttcgtaaaactcgggcagaatacctga

SEQ ID NO: 41655 - protein, 157 aa, Neisseria meningitidis
  misc_feature (142)..(142): Xaa can be any naturally occurring amino acid
MKRQAFFKLMACAAFLSAVSLRLPVLGACYAILSLYAFALYGIDKRCAIRGQRRIPEHRLLLPALLGGWVGAYFGSMTFKHKTAKKRFVVLFRLTVSGNVLATLILIYSGLNLNQYGVASPCRTICTVCGFVALSFLLIHYXYFVPPEFFVKLGQNT

SEQ ID NO: 41656 - DNA, 526 bp, Neisseria meningitidis
atgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggcgtgccgtgcggggaaaacgccgcattcccgaacaccgcctgctgctgcctgccttgttcggcggttgggcgggcgcatacttgggcagcaggatattcaggcataaaacggcgaaaaagcgttttgttgtgctgttccgtctgactgtttcgggcaatgtcctggcgaccctcatcctgatttatagtggattaaatttaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatattattttgtcccgcctgaatttttcgtaaaactcgggcagaatacctga

SEQ ID NO: 41657 - protein, 174 aa, Neisseria gonorrhoeae
  misc_feature (122)..(122): Xaa can be any naturally occurring amino acid
  misc_feature (159)..(159): Xaa can be any naturally occurring amino acid
MKRQAFFKLMACAAFLSAVSLRLPVLGACYAILSLYAFALYGIDKRRAVRGKRRIPEHRLLLPALFGGWAGAYLGSRIFRHKTAKKRFVVLFRLTVSGNVLATLILIYSGLNLNQYGVASPXAQRERFSKVLKHQVNRFRTICTVCGFVALSFLLIHYXYFVPPEFFVKLGQNT

SEQ ID NO: 41658 - DNA, 516 bp, Neisseria gonorrhoeae
atgaaacaaatgcttttggccgtcggcgtgggcgcggtgttggcgggctgcggcaaggatgccggcggttacgagggttattggcgcgaaaagtcggacaaaaaagagggcgtgattgccgtcaaaaaaaaaggcaattacttccttaataaaatcaacgtgtttacaggcaaggaggagtctttgcttttgtctgaaaaagacggcgcgctttcgataaacacggggataggggaaatcccgatcaaactttccgacgacgggaaagagctgtatgtcgaacgcaggcggtatgtgaaaaccgatgcggcgatgaaggacaaaatcatcgcccaccagaaaaagtgcggacaaacggcacaggcatacctcgacgcgcgaaatgcgttgccgtcaaaccaaacgtatcagcagcgtcaggcggcgatcgagcaattgaaacggcggtttgaagccgagtttgacgaattggaaaaagaaatcaaatgcaacggcaaaccgacattgttgttttag

SEQ ID NO: 41659 - protein, 171 aa, Neisseria gonorrhoeae
MKQMLLAVGVGAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 41660 - DNA, 150 bp, Neisseria meningitidis
atgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttcctt

SEQ ID NO: 41661 - protein, 50 aa, Neisseria meningitidis
MKQMLLAVGVVAVLAGCGKDAGGYEGYWREKSDKKEGMIAVKKEKGNYFL

SEQ ID NO: 41662 - DNA, 516 bp, Neisseria gonorrhoeae
atgaaacaaatgcttttggccgtcggcgtggcggcggtgttggcgggctgcggcaaggatgccggcggttacgagggttattggcgcgaaaagtcggacaaaaaagagggcgtgattgccgtcaaaaaaaaaggcaattacttccttaataaaatcaacgtgtttacaggcaaggaggagtctttgcttttgtctgaaaaagacggcgcgctttcgataaacacggggataggggaaatcccgatcaaactttccgacgacgggaaagagctgtatgtcgaacgcaggcggtatgtgaaaaccgatgcggcgatgaaggacaaaatcatcgcccaccagaaaaagtgcggacaaacggcacaggcatacctcgacgcgcgaaatgcgttgccgtcaaaccaaacgtatcagcagcgtcaggcggcgatcgagcaattgaaacggcggtttgaagccgagtttgacgaattggaaaaagaaatcaaatgcaacggcaaaccgacattgttgttttag

SEQ ID NO: 41663 - protein, 171 aa, Neisseria gonorrhoeae
MKQMLLAVGVAAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 41664 - DNA, 522 bp, Neisseria meningitidis
atgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttag

SEQ ID NO: 41665 - protein, 173 aa, Neisseria meningitidis
MKQMLLAVGVVAVLAGCGKDAGGYEGYWREKSDKKEGMIAVKKEKGNYFLNKIHVVTGKEESLLLSEKDGALSINTGIGEIPIKLSDDGKELYVERRQYVKTDAAMKDKIIAHQKKCGQTAQAYRDARNALPSNQTYQQHLAAIEQLKRRFEAEFDELEKEIKCNGRSPALLL

SEQ ID NO: 41666 - DNA, 369 bp, Neisseria meningitidis
aataaaatcaacgtgtttacaggtaaggaagaatctatgcttttgtctgaaaaagacggcgcgctttcgataaacacggggataggggaaatcccgatcaaactttccgacgacgggaaagagctgtatgtcgaacgcaggcagtatgtcaaaaccgatgcggcgatgaaggacaaaatcatcgcccatcagaaaaagtgcggacaaacggcacaggcatatctcgacgcgcgaaatgcgttgccgtcaaaccagacgtatcagcagcatcaggcggcgatcgagcagttgaaacggcggtttgaagccgagtttgacgaattggaaaaagaaatcaaatgcaacggcaaaccgacattgttgttttag

SEQ ID NO: 41667 - protein, 122 aa, Neisseria meningitidis
NKINVFTGKEESMLLSEKDGALSINTGIGEIPIKLSDDGKELYVERRQYVKTDAAMKDKIIAHQKKCGQTAQAYLDARNALPSNQTYQQHQAAIEQLKRRFEAEFDELEKEIKCNGKPTLLF

SEQ ID NO: 41668 - DNA, 489 bp, Neisseria gonorrhoeae
atgaaacacaccgtatccgcatcggtcatcctgcttttgaccgcttgcgcgcaattacctcaaaataacgaaaacctgtggcagccgtccgaacacatcagcagttttgcagcggaagggcggttggcagtcaaagcggaagggaaaggttcgtatgcaaatttcgattggacataccaaccgcccgtggaaaccatcaatatcaacacccctttgggcagtacgctcggacagttgtgtcaagacagggacggcgcattggcagtggacggcaaaggaaatgtctatcaggcagagggtacggaagacttgagcaggcagctggtcggtttcaaactgccaatccaatatctgcatatctgggcggaaggcaggcgtgtggcgggcgcgccttaccgcatccgttcagacggcatattggaacaatacggttggacaatcgggcagaactgccgacagtggggggcaagtccgaacgttgcaactgaa

SEQ ID NO: 41669 - protein, 163 aa, Neisseria gonorrhoeae
MKHTVSASVILLLTACAQLPQNNENLWQPSEHISSFAAEGRLAVKAEGKGSYANFDWTYQPPVETININTPLGSTLGQLCQDRDGALAVDGKGNVYQAEGTEDLSRQLVGFKLPIQYLHIWAEGRRVAGAPYRIRSDGILEQYGWTIGQNCRQWGASPNVATE

SEQ ID NO: 41670 - DNA, 582 bp, Neisseria meningitidis
atgaaacacaccgtatccgcatcggtcatcctgcttttgaccgcttgcgcgcaattacctcaaaataacgaaaacctgtggcagccgtccgaacacatcagcagttttgcagcagaagggcggttggcagtgaaagcggaagggaaaggttcgtatgcaaatttcgattggacataccaaccgcccgtggaaaccatcaatatcaatacccctttgggcagtacgctcgggcagttgtgtcaagacagggacggcgcattggcagtggacggcaaaggaaatgtctatcaggcggaaagtgcggaagaattgagcaggcagctggtcggtttcaaactgccaatccaatatctgcatatctgggcagatggcaggcgtgtggcgggcgcgccttaccgcatcctgccggacggcatattggaacaatacggttggactgtcggcagaaccgccgacagtggggggcaagtccgaacgttgcaactgaataacggaaatttgaacatcaggctggttttcaccgaaatcggtatgccgtctgaaaccgaaaccccggaacgctgtgcggcgcgcacgagataa

SEQ ID NO: 41671 - protein, 193 aa, Neisseria meningitidis
MKHTVSASVILLLTACAQLPQNNENLWQPSEHISSFAAEGRLAVKAEGKGSYANFDWTYQPPVETININTPLGSTLGQLCQDRDGALAVDGKGNVYQAESAEELSRQLVGFKLPIQYLHIWADGRRVAGAPYRILPDGILEQYGWTVGRTADSGGQVRTLQLNNGNLNIRLVFTEIGMPSETETPERCAARTR

SEQ ID NO: 41672 - DNA, 724 bp, Neisseria gonorrhoeae
atgaaaacctacgcacaggcactctataccgcagccctgctcaccgcctgcagccccgcagccgattcaaaccatccgtccggacaaaatgccccggccaataccgaatccgacggaaaaaacattaccctgctcaatgcctcgtacgatgtgacacggtatttttacaaagaatacgaccacttgtttgtcggaacataccaatccgaacaccccggcacatccgtcagcatccaacaatcccacggcggcttcagcaaacaggcattatccgtagccaacggccttcaagccgatgtcgtaaccatgaaccaatcttccgacatcgacctgctcgaaaaaaaggactggtagaaaaaggctggcaacaagccctccccgatcacgccgcaccctacaccagcactatggttttccttgtccgaaaaaacaaccccaaacagatccgcgattggaacgaccttgccaaagacggcgttaacatcgtcatcgccaagacctcgggcaacggacgctacgccttcctcggcgcatacggttacggtctgaaagccaacaacggcaacgagcaggaagcccaaaaactcgtcgcatccatcctcaaaaacacacccgtttttgaaaacggcggacgcgcccgccgccaccaccttcacacaacgcaacatcggcgacgtactcatcacttttgaaaacgaagccaactacgtcagcaaaaaactga

SEQ ID NO: 41673 - protein, 241 aa, Neisseria gonorrhoeae
  misc_feature (115)..(115): Xaa can be any naturally occurring amino acid
  misc_feature (213)..(213): Xaa can be any naturally occurring amino acid
MKTYAQALYTAALLTACSPAADSNHPSGQNAPANTESDGKNITLLNASYDVTRYFYKEYDHLFVGTYQSEHPGTSVSIQQSHGGFSKQALSVANGLQADVVTMNQSSDIDLLEKXGLVEKGWQQALPDHAAPYTSTMVFLVRKNNPKQIRDWNDLAKDGVNIVIAKTSGNGRYAFLGAYGYGLKANNGNEQEAQKLVASILKNTPVFENGGRXPPPPPSHNATSATYSSLLKTKPTTSAKN

SEQ ID NO: 41674 - DNA, 729 bp, Neisseria meningitidis
atgaaaacctacgcaccggcactctataccgcagccctgctcaccgcctgcagccccgcagccgattcaaaccatccgtccggacaaaatgccccggccaataccgaatccgacggaaaaaacattaccctgctcaacgcctcatacgatgtggcacgggatttttacaaagaatacaaccccttatttatcaaaacataccaatccgaacaccccggcacatccgtcagcatccaacagtcccacggcggctccagcaaacaggcattatccgtagccaacggccttcaagccgatgtcgtaaccatgaaccaatcctccgacatcgacctgctcgaaaaaaaaggactggtagaaaaaggctggcaacaagccctccccgaccacgccgcgccctacaccagcactatggttttccttgtccgaaaaaacaaccccaaacagatccgcgattggaacgaccttgccaaagacggcgttaacatcgtcatcgccaatcccaaaacctcgggcaacggacgctacgccttcctcggcgcatacggttacggtctgaaaaccaccaacggcaacgaacaggaagcccaaaaactcgtcgcatccatcctcaaaaacacccccgtttttgaaaacggcggacgckcgccaccaccaccttcacacaacgcaacatcggcgacgtactcatcacttttgaaaacgaagccaactacgtcagcraaaaactga

SEQ ID NO: 41675 - protein, 242 aa, Neisseria meningitidis
  misc_feature (215)..(215): Xaa can be any naturally occurring amino acid
MKTYAPALYTAALLTACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRXPPPPSHNATSATYSSLLKTKPTTSAKN

SEQ ID NO: 41676 - DNA, 729 bp, Neisseria meningitidis
atgaaaacctacgcaccggcactctataccgcagccctgctcagcgcctgcagccccgcagccgattcaaaccatccgtccggacaaaatgccccggccaataccgaatccgacggaaaaaacattaccctgctcaacgcctcatacgatgtggcacgggatttttacaaagaatacaaccccttatttatcaaaacataccaatccgaacaccccggcacatccgtcagcatccaacagtcccacggcggctccagcaaacaggcattatccgtagccaacggccttcaagccgatgtcgtaaccatgaaccaatcctccgacatcgacctgctcgaaaaaaaaggactggtagaaaaaggctggcaacaagccctccccgaccacgccgcgccctacaccagcactatggttttccttgtccgaaaaaacaaccccaaacagatccgcgattggaacgaccttgccaaagacggcgttaacatcgtcatcgccaatcccaaaacctcgggcaacggacgctacgccttcctcggcgcatacggttacggtctgaaaaccaccaacggcaacgaacaggaagcccaaaaactcgtcgcatccatcctcaaaaacacccccgtttttgaaaacggcggacgcgcgccaccaccaccttcacacaacgcaacatcggcgacgtactcatcacttttgaaaacgaagccaactacgtcagcaaaaaactga

SEQ ID NO: 41677 - protein, 242 aa, Neisseria meningitidis
MKTYAPALYTAALLSACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRAPPPPSHNATSATYSSLLKTKPTTSAKN

SEQ ID NO: 41678 - DNA, 1464 bp, Neisseria gonorrhoeae
atgaaattgggtttcaaaccgatacccctcgccattgccgcagtattgtgcgccctggttttggcactgcccgtacccgacggggtcaagcctcaggcttggacgctgctggctatgtttgtcggtgtgattgccgccattatcggcaaggttatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaattatcattccaatcccatttcgtcggctatggctattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgctgttcaatttgccaaagaccgtctgagcgagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttctcgctgctgccgtttcactgaatgccccggcgatgccgactgcgctgatgatggcggccgcatccaacattatgatgaccctcactcattatgcgaccggtacttcacctgtgattttcggctcgggctacaccacaatgggagaatggtggaaggcgggttttatcatgagcgtagtcaattttctgattttttccgttatcggcagcatttggtggaaagttctgggatattggtaa

SEQ ID NO: 41679 - protein, 487 aa, Neisseria gonorrhoeae
MKLGFKPIPLAIAAVLCALVLALPVPDGVKPQAWTLLAMFVGVIAAIIGKVMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMAITATAPNPLIVNLIAENLGSSFRLSWGAWAWAMAVPGVIAFFVMPLILYFLYPPEIKETPNAVQFAKDRLSEMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFLAAAVSLNAPAMPTALMMAAASNIMMTLTHYATGTSPVIFGSGYTTMGEWWKAGFIMSVVNFLIFSVIGSIWWKVLGYW

SEQ ID NO: 41680 - DNA, 1464 bp, Neisseria meningitidis
atgaaattgggtttcaaaccgatacccctcgccattgccgcagtattgtgcgccctggttttggcactgcccgtacccgacggggtcaagcctcaggcttggacgctgctggccatgtttgtcggtgtgattgccgccattatcggcaaggccatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatatttwytgtatccgcctgaaattaaagaaacgcccaatgccgttcaatttgccaaagaccgtctgagggagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatccaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaa

SEQ ID NO: 41681 - protein, 487 aa, Neisseria meningitidis
  misc_feature (246)..(246): Xaa can be any naturally occurring amino acid
MKLGFKPIPLAIAAVLCALVLALPVPDGVKPQAWTLLAMFVGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYXLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 41682 - DNA, 1464 bp, Neisseria meningitidis
atgaaattgggtttcaaaccgatacccctcgccattgccgcagtattgtgcgccttggttttggcactgcccgtacccgacggggtcaagcctcaggcttggacgctgctggccatgtttatcggtgtgattgccgccattatcggcaaggccatgccgttgggtgcgctgtcgattattgccgtcgggttggtcgcagtaaccggcgtaaccgccgacaaaccgggtgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgccgttcaatttgccaaagaccgtctgagggagatgggtaaaatgtcggcagacgaaatcattatggcggtcattttcggtatcttgttgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatctaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaa

SEQ ID NO: 41683 - protein, 487 aa, Neisseria meningitidis
MKLGFKPIPLAIAAVLCALVLALPVPDGVKPQAWTLLAMFIGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 41684 - DNA, 483 bp, Neisseria meningitidis
atgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaatgggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggaagcttcaattaa

SEQ ID NO: 41685 - protein, 160 aa, Neisseria meningitidis
MKLPLSYLPNIRFLSWCCLLAGIIAPATLLASPNPAEIRMQQDIQQRQREEQLRQTMQPESDVRLHQKNTGETVNQLMGDDSSQPCFAINEWVLEGEHHARFQFALKRALRETGFQAGKCLHAGNINQIMSLAQNALIGRGYTTTRILAAPQDLNSGSFN

SEQ ID NO: 41686 - DNA, 1437 bp, Neisseria gonorrhoeae
ggcaagtgtctgcatgcgggcgacattaatcaaatcatgtccttagcacaaaatgctttgatcggcaggggatataccacgacccgtatcttggctgcgccacaggatttgaatagtggcaagcttcaattaaccctgatgccgggctatctgcgctccatacgaatcgatcggtccaacgatgatcaaacccatgcaggacgtattgcagcattccaaaacaaatttcccacccgctcgaacgatctgttgaatctgcgtgatttggaacaaggactggaaaatctcaaatgtctcccgactgcggaagccgatctccaaatcgttcccgtagagagagaaccaaaccaaagtgatgtcgtggtgcaatggcggtaacgtctgctgccctactgtgtgagtgtggggatggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 41687 - protein, 477 aa, Neisseria gonorrhoeae
GKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 41688 - DNA, 1788 bp, Neisseria meningitidis
atgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaagtggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggcaagcttcaattaaccctgataccgagctatctgcgctccatacgaatcgatcggtctaacgatgatcaaacccatgcaggacgtattgcagcattccagaacaaatttcccacccgctcgaacgatctgttgaatctgcgtgatttggaacaaggactggaaaatctcaaacgtctcccgactgcggaagccgatctccaaatcgttcccgtagagggagaaccaaaccaaagtgatgtcgtggtgcaatggcggcaacgtctgctgccctaccgtgtgagtgtggggatggataattcgggtagtgaggcgacaggaaaataccaaggaaatatcactttctctgccgacaatcctttgggactgagtgatatgttctatgtaaattatggacgttcgattggcggtacgcccgatgaggaaagttttgacggccatcgcaaagaaggcggatcaaacaattacgccgtacattattcagcccctttcggtaaatggacatgggcattcaatcacaatggctaccgttaccatcaggcagtttccggattatcggaagtctatgactataatggaaaaagttacaatactgatttcggcttcaaccgcctgttgtatcgtgatgccaaacgcaaaacctatctcggtgtaaaactgtggatgagggaaacaaaaagttacattgatgatgccgaactgactgtacaacggcgtaaaactgcgggttggttggcagaactttcccacaaagaatatatcggtcgcagtacggcagattttaagttgaaatataaacgcggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgtctgccgagcggggatggtattggcgcaacgatttgagctggcaatttaaaccaggccatcagctttatcttggggctgatgtaggacatgtttcaggacaatccgccaaatggttatcgggccaaactctagtcggcacagcaattgggatacgcgggcagataaagcttggcggcaacctgcattacgatatatttaccggccgcgcattgaaaaagcccgaatttttccaatcaaggaaatgggcaagcggttttcaggtaggctatacgttttaa

SEQ ID NO: 41689 - protein, 595 aa, Neisseria meningitidis
MKLPLSYLPNIRFLSWCCLLAGIIAPATLLASPNPAEIRMQQDIQQRQREEQLRQTMQPESDVRLHQKNTGETVNQLMGDDSSQPCFAINEVVLEGEHHARFQFALKRALRETGFQAGKCLHAGNINQIMSLAQNALIGRGYTTTRILAAPQDLNSGKLQLTLIPSYLRSIRIDRSNDDQTHAGRIAAFQNKFPTRSNDLLNLRDLEQGLENLKRLPTAEADLQIVPVEGEPNQSDVVVQWRQRLLPYRVSVGMDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 41690 - DNA, 612 bp, Neisseria gonorrhoeae
atgaaacccaaattcaaaaccgttttaaccgcgctgcttttggcggtttccctgccgtctatggcggcaacccgcgtcctgatggaaaccgatatgggcaatatccgtttggttttggacgaatccaaagcctccaaaaccgttgccaatttcgtgcgctatgcccgaaaaggcttttacgacaacacgattttccaccgcgtcatcggcggcttcgtcatccaaggcgacggattgaccgaggacttggtgcaaaaggcaaccgataaggccgttgccaacgaatccggcaacggcttgaaaaacaccgtcggcaccatcgcaatggcgcggacggcagcccccgattccgccgccgcccaattctttatcaatctggcggacaacggttcgctcgactacaaaaacggacaatacggctacaccgttttcggcagggtagaaagcggaatggacaccgtttccaaaatcgcccgcgtcaaaaccgccacgcgcggcttttatcaaaacgtacccgtacagcccgtcaaaatccgtcgcgttgttgtcgggcagtaacacgcagacagacgttcagacggcgtcgcccgtttcccaaaaaacgccgtttaa

SEQ ID NO: 41691 - protein, 185 aa, Neisseria gonorrhoeae
MKPKFKTVLTALLLAVSLPSMAATRVLMETDMGNIRLVLDESKASKTVANFVRYARKGFYDNTIFHRVIGGFVIQGDGLTEDLVQKATDKAVANESGNGLKNTVGTIAMARTAAPDSAAAQFFINLADNGSLDYKNGQYGYTVFGRVESGMDTVSKIARVKTATRGFYQNVPVQPVKIRRVVVGQ

SEQ ID NO: 41692 - DNA, 557 bp, Neisseria meningitidis
atgaaacccaaattcaaaaccgttttaaccgcgctgcttttggcggtttccctgccgtctatggcggcaacccatgttttgatggaaaccgatatgggcaatatccgtttggttttggacgaatccaaagcccccaaaaccgttgctaatttcgtgcgctatgcccgaaaaggcttttacgacgacaccgtttttcaccgcgttatcgacggttttgttatccagggcggtggattgaccgaggacttggcacaaaaggcaagcgataaggccgttgccaacgaatccggcaacggcttgaaaaacaccgccggcaccatcgccatggcgcggacgacagcccccgattccgccaccagccaattctttatcaatctggcggaccakcttcgctcgactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaa

SEQ ID NO: 41693 - protein, 185 aa, Neisseria meningitidis
  misc_feature (129)..(130): Xaa can be any naturally occurring amino acid
MKPKFKTVLTALLLAVSLPSMAATHVLMETDMGNIRLVLDESKAPKTVANFVRYARKGFYDDTVFHRVIDGFVIQGGGLTEDLAQKASDKAVANESGNGLKNTAGTIAMARTTAPDSATSQFFINLADXXSLDYKNGQYGYTVFGRVESGMNTVSKIARVKTATRGFYQNVPVQPVKIRRVVVGQ

SEQ ID NO: 41694 - DNA, 558 bp, Neisseria meningitidis
atgaaacccaaattcaaaaccgttttaaccgcgctgcttttggcggtttccctgccgtctatggcggcaacccatgttttgatggaaaccgatatgggcaatatccgtttggttttggacgaatccaaagcacccaaaaccgttgccaatttcgtgcgctatgcccgaaaaggcttttacgacaatacgatttttcaccgcgtcatcggcggcttcgttatccaaggcggcggattgaccgaggacttggcacaaaaggcaagcgataaggccgttgccaacgaatccggcaacggcttgaaaaacactgtcggcaccatcgccatggcgcggacggccgatccggattccgccaccagccaattctttatcaatctggtggacaatgattcgctcaactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaa

SEQ ID NO: 41695 - protein, 185 aa, Neisseria meningitidis
MKPKFKTVLTALLLAVSLPSMAATHVLMETDMGNIRLVLDESKAPKTVANFVRYARKGFYDNTIFHRVIGGFVIQGGGLTEDLAQKASDKAVANESGNGLKNTVGTIAMARTADPDSATSQFFINLVDNDSLNYKNGQYGYTVFGRVESGMNTVSKIARVKTATRGFYQNVPVQPVKIRRVVVGQ

SEQ ID NO: 41696 - DNA, 339 bp, Neisseria meningitidis; identical to SEQ ID NO: 41560

SEQ ID NO: 41697 - protein, 112 aa, Neisseria meningitidis; identical to SEQ ID NO: 41561

SEQ ID NO: 41698 - DNA, 689 bp, Neisseria gonorrhoeae
atgaaaaaaatcatcgcctccgcgcttatcgcaacattcgcactcaccgcctgccaagacgacacgcaggcgcggctcgaacggcagcagaaacagattgaagccctgcaacagcagctcgcacagcaggcagacgatacggtttaccaactgactcccgaagcagtcaaagacaccattcctgcccaggcgcaggcaaacggcaacaacggtcagcccgttaccggcaaagacgggcagcagtatatttacgaccaatcgacaggaagctggctgctgcaaagcctgattggcgcggcggcaggcgcgtttatcggcaacgcgctggcaaacaaattcacacgggcgggcaaccaagacagccccgtcgcccgtcgcgcgcgtgctgcctaccatcagtccgcacgccccaatgcgcgcaccagcagggatttgaacacgcgcagcctccgtgcaaaacaacaggcggcgcaggcgcagcgttaccgcccgacaacgcgcccgcccgtcaattaccgccatcgcgctatgcgcggtttcggcagaaggcggtaaacccggcgcgtcaatgccgtctgaagggctttcagacggcatttttgtatttgttaggggcattgttatgttgccgtttgattttcagacggcattttgtttccaagcgtttgatgtcgggatggcaattctga

SEQ ID NO: 41699 - protein, 229 aa, Neisseria gonorrhoeae
MKKIIASALIATFALTACQDDTQARLERQQKQIEALQQQLAQQADDTVYQLTPEAVKDTIPAQAQANGNNGQPVTGKRRAAVYLRPIDRKLAAAKPDWRGGRRVYRQRAGKQIHTGGQPRQPRRPSRACCLPSVRTPQCAHQQGFEHAQPPCKTTGGAGAALPPDNAPARQLPPSRYARFRQKAVNPARQCRLKGFQTAFLYLLGALLCCRLIFRRHFVSKRLMSGWQF

SEQ ID NO: 41700 - DNA, 617 bp, Neisseria meningitidis
  misc_feature (528)..(528): n is a, c, g, or t
cggctcgaacagcagcagaaacagattgaagccctgcaacagcagctcgcacagcaggcagacgatacggtttaccaactgactcccgaagcagtcaaagacaccattcctgccgaagcacaggcaaacggcaacaacgggcaacccgttaccggtaaagacgggcagcagtatatttacgaccaatcgacaggaagctggctgctgcaaagcctggtcggcgcggcggcaggcgcgtttatcggcaacgcgctggcaaacaaattcacacgggcaggcaaccaagacagtcccgtcgcccggcgcgcgcgtgcagcctaccatcagtccgcacgccccaatgcgcgcaycagcagggatttgaacacgcgcagcctccgtgcaaaacaacaggcggcgcakgcgcagcgttaccgcccgacaacgcgcccgsccgscaattaccgccgccccgctatgcgcggtttcggcaggaggcggtaaacccggcgcgccaatgccgtctgaagagctttcagacggcatttntgcatttgttagggacattgttatgttgccgtttgattttcagacggcattttgtttccaagcgtttgatgtcgggatggcaattctga

SEQ ID NO: 41701 - protein, 205 aa, Neisseria meningitidis
  misc_feature (53)..(53): Xaa can be any naturally occurring amino acid
  misc_feature (135)..(135): Xaa can be any naturally occurring amino acid
  misc_feature (145)..(145): Xaa can be any naturally occurring amino acid
  misc_feature (177)..(177): Xaa can be any naturally occurring amino acid
RLEQQQKQIEALQQQLAQQADDTVYQLTPEAVKDTIPAEAQANGNNGQPVTGXRRAAVYLRPIDRKLAAAKPGRRGGRRVYRQRAGKQIHTGRQPRQSRRPARACSLPSVRTPQCAHQQGFEHAQPPCKTTGGAXAALPPDNAPXRQLPPPRYARFRQEAVNPARQCRLKSFQTAFXHLLGTLLCCRLIFRRHFVSKRLMSGWQF

SEQ ID NO: 41702 - DNA, 689 bp, Neisseria meningitidis
atgaaaaaaatcatcgcctccgcgcttatcgcaacattcgcactcgccgcctgccaagacgacgcgcaggcgcggctcgaacagcagcagaaacagattgaagccctgcaacagcagctcgcacagcaggcagacgatacggtttaccaactgactcccgaagcagtcaaagacaccattcctgccgaagcacaggcaaacggcaacaacgggcaacccgttaccggtaaagacgggcagcagtatatttacgaccaatcgacaggaagctggctgctgcaaagcctggtcggcgcggcggcaggcgcgtttatcggcaacgcgctggcaaacaaattcacacgggcaggcaaccaagacagtcccgtcgcccggcgcgcgcgtgccgcctaccatcagtccgcacatcccaatgcgcgcaccagcagggatttgaacacgcgcagcctccgtgcaaaacaacaggcggcgcaggcgcagcgttaccgcccgacaacgcgcccgcccgccaattaccgccgccccgccatgcgcggtttcggcagaaggcggtaaatccggcgtgccaatgccgtctgaagggctttcagacggcatttttgtatttgttagggacattgttatgttgccgtttgatttttagacggcattttgtttccaagagtttgatgtcgggatggcaattctga

SEQ ID NO: 41703 - protein, 228 aa, Neisseria meningitidis
  misc_feature (76)..(76): Xaa can be any naturally occurring amino acid
MKKIIASALIATFALAACQDDAQARLEQQQKQIEALQQQLAQQADDTVYQLTPEAVKDTIPAEAQANGNNGQPVTXRRAAVYLRPIDRKLAAAKPGRRGGRRVYRQRAGKQIHTGRQPRQSRRPARACRLPSVRTSQCAHQQGFEHAQPPCKTTGGAGAALPPDNAPARQLPPPRHARFRQKAVNPACQCRLKGFQTAFLYLLGTLLCCRLIFRRHFVSKSLMSGWQF

SEQ ID NO: 41704 - DNA, 1518 bp, Neisseria meningitidis
atgttgtatttcagatacggctttttggttgtttggtgtgcggcaggtgtttctgccgcctatggggcggatgcgcccgcgattttggatgacaaggcattgttgcaggtgcagcggtcggtgtcggataagtgggcggaatcagattggaaagttgaaaatgatgccccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgcggaggcggcaaaattggatttgccggcaccggttttggaaaatgtggggcgttttcggaaaaaaacggaggggctgacgggctggcgtttttcgggcggcatcagtccggcggtcaatagaaatgccaataatgccgcgccgcaatattgccggcaaaacggaggccggcagatatgcagtgtcagccgggcggagcgggcggcagggttgaattatgaaatcgaggcggaaaagctgacgccgttggcagataatcattatttgttgttccgttccaatatcggcggcacgagctattatttcagtaaaaaatcagcttatgatgacgggttcggcagggcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatagggcggaatacaataacggcaggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggttgggcgcaggagtggcggcagttgggcggtttgaacagtcgggtttccgcgtcttatgcccgccgcaactataagggcattgcggctttctcgacagaggcgcaacgcaaccgcgaatggaatgtctcgctggctttgagccacgacaagttgtcgtacaaaggtatcgtgccggcgttgaattatcgtttcggcaggacggaaagtaatgtgccgtatgcgaaacgccgcaacagcgaggtgtttgtgtcggcggattggcggttttga

SEQ ID NO: 41705 - protein, 505 aa, Neisseria meningitidis
MLYFRYGFLVVWCAAGVSAAYGADAPAILDDKALLQVQRSVSDKWAESDWKVENDAPRVVDGDFLLAHPKMLEHSLRDALNGNQADLIASLADLYAKLPDYDAVLYGRARALLAKLAGRPAEAVARYRELHGENAADERILLDLAAAEFDDFRLKSAERHFAEAAKLDLPAPVLENVGRFRKKTEGLTGWRFSGGISPAVNRNANNAAPQYCRQNGGRQICSVSRAERAAGLNYEIEAEKLTPLADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGIAAFSTEAQRNREWNVSLALSHDKLSYKGIVPALNYRFGRTESNVPYAKRRNSEVFVSADWRF

SEQ ID NO: 41706 - DNA, 1518 bp, Neisseria meningitidis
atgttgtatttcagatacggttttttggttgtttggtgtgcggcaggtgtttctgccgcctatggggcggatgcgcccgcgattttggatgacaaggcattgttgcaggtgcagcggtcggtgtcggataagtgggcggaatcggattggaaagttgacaatgatgccccgcgcgtggttgacggggattttttgttggcgcatccgaaaatgttggaacatagtttgcgcgacgtgctcaacggcaatcaggcggatttgatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgccgaggcggaaaaattggatttgccggcgccggttttggaaaatgtggggcgttttcggaaaaaagcggaggggctgacgggctggcgtttttcgggcggcatcagtccggcggtcaatagaaatgccaataatgccgcgccgcagtattgccggcaaaacggaggccggcagatatgcagtgtcagccgggcggagcgggcggcaggcttgaattatgaaatcgaggcggaaaaactgacggcgttggcagataatcattatttgttgttccgttccaatatcggcggcacgagctattatttcagtaaaaaatcagcttatgacgacgggttcggcagagcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagttgtcccatacttaccgcccaaacccgggatggcaattttcggtcgcgctggaacattaccgccaacgctaccgcgaacaggatagggcggaatacaataacggtcggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggctgggcgcaggagtggcggcagttgggcggtttgaacagtcgggtttccgcgtcttatgcccgccgcaactataagggcgttgcggctttctcgacagaggcgcaacgcaaccgcgaatggaatgtctcgctggctttgagccacgacaagttgtcgtacaaaggtatcgtgcccgcgttgaattatcgtttcggcaggacggaaagtaatgtgccgtatgcgaaacgccgcaacagcgaggtgtttgtgtcggcggattggcggttttga

SEQ ID NO: 41707 - protein, 505 aa, Neisseria meningitidis
MLYFRYGFLVVWCAAGVSAAYGADAPAILDDKALLQVQRSVSDKWAESDWKVDNDAPRVVDGDFLLAHPKMLEHSLRDVLNGNQADLIASLADLYAKLPDYDAVLYGRARALLAKLAGRPAEAVARYRELHGENAADERILLDLAAAEFDDFRLKSAERHFAEAEKLDLPAPVLENVGRFRKKAEGLTGWRFSGGISPAVNRNANNAAPQYCRQNGGRQICSVSRAERAAGLNYEIEAEKLTALADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGVAAFSTEAQRNREWNVSLALSHDKLSYKGIVPALNYRFGRTESNVPYAKRRNSEVFVSADWRF

SEQ ID NO: 41708 - DNA, 609 bp, Neisseria gonorrhoeae
atgaaacccaaaccacacaccgtccgcaccctgattgccgccgtcctcagccttgccctcggcggctgcttcagcgcagtcgtcggcggggccgccgtcggcgcaaaatccgtcatcgaccgccgaaccaccggcgcgcaaaccgatgacaacgttatggcgttgcgtatcgaaaccaccgcccgttcctacctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtatacaactacattaccgtcgcctccctgccgcgcactgcgggcgacatcgccggcgacacttggaacacgtccaaagtccgcgccacgctgctgggcatcagccccgctacacaggcgcgcgtcaaaatcattacctacggcaatgtaacctacgttatgggcatcctcacccccgaagaacaggcgcagattacccaaaaagtcagcaccaccgtcggcgtacaaaaagtcattaccctctaccaaaactacgtccaacgctga

SEQ ID NO: 41709 - protein, 202 aa, Neisseria gonorrhoeae
MKPKPHTVRTLIAAVLSLALGGCFSAVVGGAAVGAKSVIDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIITYGNVTYVMGILTPEEQAQITQKVSTTVGVQKVITLYQNYVQR

SEQ ID NO: 41710 - DNA, 384 bp, Neisseria meningitidis
atgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgcc

SEQ ID NO: 41711 - protein, 128 aa, Neisseria meningitidis
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTA

SEQ ID NO: 41712 - DNA, 609 bp, Neisseria meningitidis
atgaaacccaaaccgcacaccgtccgcaccctgactgccgccgtcctcagccttgccctcggcggctgcgtcagcgcagtcgtcggcggcgcggcggtcggcgcgaaatccgccgtcgaccgccgaaccaccggcgcgcaaaccgacgacaacgtaatggcgctgcgtatcgaaaccaccgcccgctcctatctgcgccaaaacaaccaaaccaaaggctacacgccccaaatctccgttgtcggctacaaccgccacctgctgctgctcggacaagtcgccaccgaaggcgagaaacagttcgtcggtcagattgcacgttccgaacaggccgccgaaggcgtgtacaactacattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctga

SEQ ID NO: 41713 - protein, 202 aa, Neisseria meningitidis
MKPKPHTVRTLTAAVLSLALGGCVSAVVGGAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 41714 - DNA, 609 bp, Neisseria gonorrhoeae; identical to SEQ ID NO: 41708

SEQ ID NO: 41715 - protein, 202 aa, Neisseria gonorrhoeae; identical to SEQ ID NO: 41709

SEQ ID NO: 41716 - DNA, 609 bp, Neisseria meningitidis
atgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctga

SEQ ID NO: 41717 - protein, 202 aa, Neisseria meningitidis
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 41718 - DNA, 609 bp, Neisseria meningitidis; identical to SEQ ID NO: 41712

SEQ ID NO: 41719 - protein, 202 aa, Neisseria meningitidis; identical to SEQ ID NO: 41713

SEQ ID NO: 41720 - DNA, 867 bp, Neisseria gonorrhoeae
atgaaaaatattctcttagtatttgttagctttgtgccattatgtgtccgcactgatctgccgctgaatatcgaagacataatgaccgacaagggaaaatggaaactggaaacttcccttacctacctgaacagcgaaaacagccgcgccgcacttgcctcaccggtttacattcagaccggctccgcttcctttatccccgtcccgaccgaaattcaggaaaacggcagcaataccgatatgctcgccggcacgctcggtttgcgctacggactgaccggcaataccgacatttacggcagcggcagctatctgtggcacgaagaacgcaaactcgacggcaacggcaaaacccgcaacaaacggatgtccgacatatccgccggcatcagccacaccttccttaaagacggcaaaaatcccgcactcatcgctttcctcgaaagcacggtttacgaaaaatcgcgcaacaaagcctcgtcgggaaaatcgtggctcatcggcgccaccacctacaaagccatagatccgattgtcctttccctcaccgccgcctaccgcatcaacggcagcaaaaccctttcagacgacgtcaaatacaaagcaggcaattactggatgctgaatcccaacatctcatttgccgccaacgacagaatcagcctgaccggaggcatccaatggctgggcaaacagcccgaccgcatagacggcaaaaaagaatccgcaagaaacacatccacctacgcccatttcggcgcaggtttcggtttcaccaaaaccgcggctttaaacgcatccgcacgtttcaacgtttcagggcaaagcagttccgaactgaaattgggcgtacagcatacattttaa

SEQ ID NO: 41721 - protein, 288 aa, Neisseria gonorrhoeae
MKNILLVFVSFVPLCVRTDLPLNIEDIMTDKGKWKLETSLTYLNSENSRAALASPVYIQTGSASFIPVPTEIQENGSNTDMLAGTLGLRYGLTGNTDIYGSGSYLWHEERKLDGNGKTRNKRMSDISAGISHTFLKDGKNPALIAFLESTVYEKSRNKASSGKSWLIGATTYKAIDPIVLSLTAAYRINGSKTLSDDVKYKAGNYWMLNPNISFAANDRISLTGGIQWLGKQPDRIDGKKESARNTSTYAHFGAGFGFTKTAALNASARFNVSGQSSSELKLGVQHTF

SEQ ID NO: 41722 - DNA, 870 bp, Neisseria meningitidis; identical to SEQ ID NO: 40650

SEQ ID NO: 41723 - protein, 289 aa, Neisseria meningitidis
MKRIFLPALPAILPLSTYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNSKTRNKRMSDVSLGISHTFLKDDKNPALISFLESTVYEKSRNKASSGKSWLIGATTYKAIDPIVLSLTAAYRINGSKTLSDGIRYKSGNYLLLNPNISFAANDRISLTGGIQWLGRQPDRTDGKRESSRNTSTYAHFGAGFGFTKTTALNASARFNVSGQSSSELKFGVQHTF

SEQ ID NO: 41724 - DNA, 870 bp, Neisseria meningitidis; identical to SEQ ID NO: 40652

SEQ ID NO: 41725 - protein, 289 aa, Neisseria meningitidis; identical to SEQ ID NO: 40653

SEQ ID NO: 41726 - DNA, 222 bp, Neisseria meningitidis
atgaaacgattgactttattggcctttgttttggctgccggtgcggtttccgcctctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaactatcggcatccgcgacgtaaacgcaccc

SEQ ID NO: 41727 - protein, 74 aa, Neisseria meningitidis
MKRLTLLAFVLAAGAVSASPKADVEKGKQVAATVCAACHAADGNSGIAMYPRLAAQHTAYIYHQTIGIRDVNAP

SEQ ID NO: 41728 - DNA, 624 bp, Neisseria meningitidis
atgaaacgattgactttattggcctttgttttggctgccggtgcggtttccgcatctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaaccatcggcatccgcgacggtaaacgcacccacggttcggcagctgtgatgaaaccggtggtaatgaatttgagcgatcaggatattttgaacgtatccgcattctatgccaaacagcagcccaaatccggtgaagccaatcctaaggaaaatcccgaattgggtgcgaaaatctatcgcggcggtttgagcgataaaaaagtgccggcgtgtatgtcctgccacggtccgagcggtgcgggtatgccggggggcggaagcgaaattcaggcttatccgcgtttgggcggtcagcatcaggcatatattgttgaacagatgaatgcctacaagtccggtcagcgtaaaaataccatcatggaagatattgcaaaccgtatgtctgaagaagatttgaaagcggtcgccaactttatccaaggtttgcgttaa

SEQ ID NO: 41729 - protein, 207 aa, Neisseria meningitidis
MKRLTLLAFVLAAGAVSASPKADVEKGKQVAATVCAACHAADGNSGIAMYPRLAAQHTAYIYHQTIGIRDGKRTHGSAAVMKPVVMNLSDQDILNVSAFYAKQQPKSGEANPKENPELGAKIYRGGLSDKKVPACMSCHGPSGAGMPGGGSEIQAYPRLGGQHQAYIVEQMNAYKSGQRKNTIMEDIANRMSEEDLKAVANFIQGLR

SEQ ID NO: 41730 - DNA, 339 bp, Neisseria gonorrhoeae; identical to SEQ ID NO: 41240

SEQ ID NO: 41731 - protein, 112 aa, Neisseria gonorrhoeae; identical to SEQ ID NO: 41241

SEQ ID NO: 41732 - DNA, 309 bp, Neisseria meningitidis; identical to SEQ ID NO: 41242

SEQ ID NO: 41733 - protein, 102 aa, Neisseria meningitidis; identical to SEQ ID NO: 41243

SEQ ID NO: 41734 - DNA, 309 bp, Neisseria meningitidis; identical to SEQ ID NO: 41244

SEQ ID NO: 41735 - protein, 102 aa, Neisseria meningitidis; identical to SEQ ID NO: 41243

SEQ ID NO: 41736 - DNA, 1845 bp, Neisseria gonorrhoeae
atgattatgttacccgcccgtttcactattttatctgtcctcgcagcagccctgcttgccggacaggcgtatgctgccggcgcggcggatgtggagctgccgaaggaagtcggaaaggttttaaggaaacatcggcgttacagcgaggaagaaatcaaaaacgaacgcgcacggcttgcggcagtgggcgaacgggtcaacagggtgtttacgctgttgggcggtgaaacggctttgcagaaagggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagatcgagcctataccgggtgaggcgcaaaaacgggcggggtggctgcggaacgtattgagggaagggggaaatcagcatctggacgggttggaagaggtgctggcgcaatcggacgatgtgcaaaaacgcaggatatttttgctgctggtgcaagccgccgtgcagcagggtggggtggctcaaaaagcatcgaaagcggttcgccgtgcggcgttgaagtatgaacatctgcccgaagcggcggttgccgatgcggtgttcggcgtacagggacgcgaaaaggaaaaggcaatcgaagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcgtaagccggatgatgcctatgcgcgtttgaacgtgctgttggaacacaacccgaatgcaaacctgtatattcaggcggcgatattggcggcaaaccgaaaagaaggtgcgtccgttatcgacggctacgccgaaaaggcatacggcagggggacgggggaacagcggggcagggcggcaatgacggcggcgatgatatatgccgaccgcagggattacgccaaagtcaggcagtggttgaaaaaagtgtccgcgccggaatacctgttcgacaaaggcgtgctggcggctgcggcggctgccgaattggacggaggccgggcggctttgcggcagatcggcagggtgcggaaacttcccgaacagcaggggcggtattttacggcagacaatttgtccaaaatacagatgctcgccctgtcgaagctgcccgacaaacgggaagccctgatcgggctgaacaacatcatcgccaaactttcggcggcgggaagcacggaacctttggcggaagcattggcacagcgttccattatttacgaacagttcggcaaacggggaaaaatgattgccgaccttgaaaccgcgctcaaacttacgcccgataatgcacaaattatgaataatctgggctacagcctgctttccgattccaaacgtttggacgagggtttcgccctgcttcagacggcataccaaatcaacccggacgataccgccgttaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttaggggagacaagaaaatatggcgggagacgctcaaacgctacggaatcgccttgcccgagccttcccgaaaaccccggaaataa

SEQ ID NO: 41737 - protein, 614 aa, Neisseria gonorrhoeae
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKRAGWLRNVLREGGNQHLDGLEEVLAQSDDVQKRRIFLLLVQAAVQQGGVAQKASKAVRRAALKYEHLPEAAVADAVFGVQGREKEKAIEALQRLAKLDTEILPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 41738 - DNA, 1851 bp, Neisseria meningitidis
atgattatgttacctaaccgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgaaatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacggaggaacagcggagcagggcggcgctaacggcggcgatgatgtatgccgaccgcagggattacgccaaagtcaggcagtggctgaaaaaagtatccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgctcgccctgtcgaagctgcccgataaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctgaccgattccaaacgtttggacgaaggtttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 41739 - protein, 616 aa, Neisseria meningitidis
MIMLPNRFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALKYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTEEQRSRAALTAAMMYADRRDYAKVRQWLKKVSAPEYLFDKGVLAAAAAVELDGGRAALRQIGRVRKLPEQQGRYFTADNLSKIQMLALSKLPDKREALRGLDKIIEKPPAGSNTELQAEALVQRSVVYDRLGKRKKMISDLERAFRLAPDNAQIMNNLGYSLLTDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 41740 - DNA, 1839 bp, Neisseria meningitidis
atgttacccgcccgtttcaccattttatctgtgctcgcggcagccctgcttgccgggcaggcgtatgccgccggcgcggcggatgcgaagccgccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctagacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgagatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacgggggaacagcggggcagggcggcaatgacggcggcgatgatatatgccgaccgaagggattacaccaaagtcaggcagtggttgaaaaaagtgtccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgttcgccctgtcgaagctgcccgacaaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctttccgattccaaacgtttggacgaaggcttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 41741 - protein, 612 aa, Neisseria meningitidis
MLPARFTILSVLAAALLAGQAYAAGAADAKPPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALRYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTGEQRGRAAMTAAMIYADRRDYTKVRQWLKKVSAPEYLFDKGVLAAAAAVELDGGRAALRQIGRVRKLPEQQGRYFTADNLSKIQMFALSKLPDKREALRGLDKIIEKPPAGSNTELQAEALVQRSVVYDRLGKRKKMISDLERAFRLAPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 41742 - DNA, 609 bp, Neisseria gonorrhoeae
ttgtcttatcgtttgaatgctgcaccgatgtttaacgataatcctgttgtttacggaaaaatcaaattgcagagttggaaagcgcggcgggatttcaatattgtaaagcaggatttggatttttcctgcggggcggcttcggtggcgacgcttttgaacaatttttacgggcaaaagctgacggaagaagaagtgttggaaaaactgggtaaggaacagatgcgcgcgtcgtttgaggatatgcggcgcattatgcccgatttgggttttgaggcgaaaggctatgccctgtctttcgaacagctcgcgcagttgaaaatccccgtcatcgtgtatctgaaataccgcaaagacgaccatttttcggtattgcgcggagtggatggcaatacggttttgcttgccgacccgtcgccgggtcatgtttcgatgagcagggcgcagtttttggaggcttggcaaacccgtgagggaaatttggcaggcaaaattttggcggtcgtgccgaaaaaagcggaggcgatttcaaataaattgtttttcacacatcatcccaagcggcagacggagtttgcagtcggacaggtaaaatggtggcgtgcttattga

SEQ ID NO: 41743 - protein, 202 aa, Neisseria gonorrhoeae
LSYRLNAAPMFNDNPVVYGKIKLQSWKARRDFNIVKQDLDFSCGAASVATLLNNFYGQKLTEEEVLEKLGKEQMRASFEDMRRIMPDLGFEAKGYALSFEQLAQLKIPVIVYLKYRKDDHFSVLRGVDGNTVLLADPSPGHVSMSRAQFLEAWQTREGNLAGKILAVVPKKAEAISNKLFFTHHPKRQTEFAVGQVKWWRAY

SEQ ID NO: 41744 - DNA, 657 bp, Neisseria meningitidis
atgatgaagttcaaatatgtttttctgttggcgtgtgttgtcgtttctttatcttatcgtttgaatgctgcaccgatgtttaacgataatcctgttgtttacggaaaaatcaaagtgcagagttggaaagcgcggcgggatttcaatattgtaaagcaggatttggatttttcctgtggggcggcttcggtggcgacgcttttgaacaatttttacgggcaaacgctgacggaagaagaagtgttgaaaaagctggataaggagcagatgcgcgcgtcgtttgaggatatgcggcgcattatgcctgatttgggttttgaggcgaagggctatgccctgtctttcgagcagctcgcgcagttgaaaatccccgtcatcgtgtatctgaaataccgcaaagacgaccatttttcggtattgcgcggtatagacggcaatacggttttgcttgccgacccgtcgctggggcatgtttcaatgagcagggcgcagtttttggatgcttggcaaacccgtgagggaaatttggcaggtaagattttggctgtcataccgaaaaaagccgagacaatttcaaataaattgtttttcacacaacacccaaaacggcagacggagtttacagtcggacaaatcaggcaagcacgtgcagagtaa

SEQ ID NO: 41745 - protein, 218 aa, Neisseria meningitidis
MMKFKYVFLLACVVVSLSYRLNAAPMFNDNPVVYGKIKVQSWKARRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFLDAWQTREGNLAGKILAVIPKKAETISNKLFFTQHPKRQTEFTVGQIRQARAE

SEQ ID NO: 41746 - DNA, 657 bp, Neisseria meningitidis
  misc_feature (497)..(497): n is a, c, g, or t
atgatgaagttcaaatatgtttttctgttggcgtgtgttgtcgtttctttatcttatcgtttgaatgctgcaccgatgtttaacgataatcctgttgtttacggaaaaatcaaagtgcagagttggaaagaaaggcgggatttcaatattgtaaagcaggatttggatttttcctgcggggcggcttcggtggcgacgcttttgaacaatttttacgggcaaacgctgacggaagaagaagtgttgaaaaagctggataaggagcagatgcgcgcgtcgtttgaggatatgcggcgcattatgccagatttgggttttgaagcgaaaggctatgccctgtctttcgagcagctcgcacagttgaaaatccccgtcatcgtgtatctgaaataccgcaaggatgatcatttctcggtattgcgcgggatagacggcaatacggttttgcttgccgacccgtcgctgggtcatgtttcaatgagcagggcgcagttttnggatgcttggcaaacccgtgagggaaatttggcaggtaagattttggcggtcgtgccgaaaaaagccgagacaatttcaaataaattgtttttcacacatcatcccaagcggcagacggagtttgcagtcggacaaatcaggcaagcacgtgcagagtaa

SEQ ID NO: 41747 - protein, 218 aa, Neisseria meningitidis
  misc_feature (166)..(166): Xaa can be any naturally occurring amino acid
MMKFKYVFLLACVVVSLSYRLNAAPMFNDNPVVYGKIKVQSWKERRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFXDAWQTREGNLAGKILAVVPKKAETISNKLFFTHHPKRQTEFAVGQIRQARAE

SEQ ID NO: 41748 - DNA, 561 bp, Neisseria gonorrhoeae
atgaaaaaaatcatcttcgccgcgctcgcagcggcagccgtcggcactgcctccgccacctacaaagtggacgaatatcacgccaacgtccgtttcgccatcgaccacttcaacaccagcaccaacgtcggcggtttttacggtctgaccggttccgtcgagttcgatcaagcaaaacgcgacggcaaaatcgacatcaccattcccgtcgccaacctgcaaagcggttcgcaacccttcaccggccacctgaaatccgccgacatcttcgatgccgctcaatatccggacatccgcttcgtttccaccaaattcaacttcaacggcaaaaaacttgtttccgttgacggcaacctgaccatgcgcggcaaaaccgcccccgtcaaactcaaagccgaaaaattcaactgctaccaaagcccgatggcggaaaccgaagtttgcggcggcgacttcagcaccaccatcgaccgcaccaaatggggcgtggactacctcgttaacgccggtatgaccaaaaacgtccgcatcgacatccaaatcgaagctgcaaaacaataa

SEQ ID NO: 41749 - protein, 186 aa, Neisseria gonorrhoeae
MKKIIFAALAAAAVGTASATYKVDEYHANVRFAIDHFNTSTNVGGFYGLTGSVEFDQAKRDGKIDITIPVANLQSGSQPFTGHLKSADIFDAAQYPDIRFVSTKFNFNGKKLVSVDGNLTMRGKTAPVKLKAEKFNCYQSPMAETEVCGGDFSTTIDRTKWGVDYLVNAGMTKNVRIDIQIEAAKQ

SEQ ID NO: 41750 - DNA, 564 bp, Neisseria meningitidis; identical to SEQ ID NO: 38809

SEQ ID NO: 41751 - protein, 187 aa, Neisseria meningitidis; identical to SEQ ID NO: 38810

SEQ ID NO: 41752 - DNA, 564 bp, Neisseria meningitidis
atgaaaaaaatcatcatcgccgcgctcgcagcagccgccatcggcactgcctccgccgccacctacaaagtggacgaatatcacgccaacgcccgtttctctatcgaccatttcaacaccagcaccaacgtcggcggtttttacggtctgaccggttccgttgagttcgaccaagcaaaacgcgacggtaaaatcgacatcaccatccccgttgccaacctgcaaagcggttcgcaacactttaccgaccacctgaaatcagccgacatcttcgatgccgcccaatatccggacatccgctttgtttccaccaaattcaacttcaacggcaaaaaactggtttccgttgacggcaacctgaccatgcacggcaaaaccgcccccgtcaaactcaaagccgaaaaattcaactgctaccaaagcccgatgttgaaaaccgaagtttgcggcggcgacttcagcaccaccatcgaccgcaccaaatggggcatggactacctcgttaacgttggtatgaccaaaagcgtccgcatcgacatccaaatcgaggcagccaaacaataa

SEQ ID NO: 41753 - protein, 187 aa, Neisseria meningitidis
MKKIIIAALAAAAIGTASAATYKVDEYHANARFSIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMLKTEVCGGDFSTTIDRTKWGMDYLVNVGMTKSVRIDIQIEAAKQ

SEQ ID NO: 41754 - DNA, 477 bp, Neisseria meningitidis
atgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataa

SEQ ID NO: 41755 - protein, 158 aa, Neisseria meningitidis
MKKFYFVLLALGLAACGQEQSQKADAEQYFFANKYQFADEKQAFYFERAARFRVLQQGLGGDFERFLKGEIPNQENLAKYRENITQAVAYYADTNGDDDPYRVCKQAAQDAEILMKSMVTSGGGGTTDLDKESYQNYRKSMQECRKTITEAEANLPKK

SEQ ID NO: 41756 - DNA, 993 bp, Neisseria gonorrhoeae
atgtttaaaaaattcaaaccggtactgttgtcattttttgcacttgtatttgccttttggctgggaacaggtattgcctatgagattaatccgcgttggtttttgagcgatacggcaactgaagtacctgaaaatccgaatgcttttgtggcgaaacttgcccgcctgttccgaaatgccgacagggcggttgtcatcgtgaaggaatcgatgaggacggaggaaagccttgccggagctgtggatgacggtccgttgcagtcggagaaggattatctcgcgctcgctatccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggctcacggggaaaattatgaaacgacaggagaatatcgggttgtttggcaaccggacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcgaagagagcaaccggattgcatcggactcgcgcgattatgtgttttatcagaatatgcgggaattgatgccccgggggatgaaggcgaacagtcttgtggtcggctatgatgcggacggtctgccgcaaaaagtctattggagtgtcgacaatggaaaaaaaccccaaagtgtcgaatattatttgaaaaacggaaatctttttattgcccaatcttcgacggtaaccttgaaaacggatggcgtaacggcggatatgcaaacctatcatgcgcaacaaacgttgtatttggatggg

SEQ ID NO: 41757 - protein, 331 aa, Neisseria gonorrhoeae
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSVDNGKKPQSVEYYLKNGNLFIAQSSTVTLKTDGVTADMQTYHAQQTLYLDG

SEQ ID NO: 41758 - DNA, 1134 bp, Neisseria meningitidis; identical to SEQ ID NO: 41292

SEQ ID NO: 41759 - protein, 377 aa, Neisseria meningitidis; identical to SEQ ID NO: 41293

SEQ ID NO: 41760 - DNA, 1125 bp, Neisseria meningitidis; identical to SEQ ID NO: 41294

SEQ ID NO: 41761 - protein, 374 aa, Neisseria meningitidis; identical to SEQ ID NO: 41295

SEQ ID NO: 41762 - DNA, 2406 bp, Neisseria gonorrhoeae
ttggctcgtttattttcactcaaaccactggtgctggcattgggcttctgtttcggcacgcattgcgccgccgataccgttgcggcggaagaggcggacgggcgtgtcgcagaaggcggtgcgcagggcgcgtccgaatccgcacaagcttccgatttgaccctcggttcgacctgcctgttttgcagtaacgaaagcggcagccccgagagaaccgaagccgccgtccaaggcagcggcgaagcatccgtccccgaagactatacgcgcattgttgccgacaggatggaaggacagtcgaaggttaaggtgcgcgcggaaggaagcgttatcatcgaacgggacggcgcagtcctcaataccgattgggcggattacgaccagtcgggcgacaccgttaccgtaggcgaccggttcgccctccaacaggacggtacgctgattcggggcgaaaccctgacctacaatctcgatcagcagaccggcgaagcgcacaacgtccgtatggaaaccgaacaaggcggacggcggctgcaaagcgtcagccgcaccgccgaaatgttgggcgaagggcgttacaaactgacggaaacccaattcaacacctgttccgccggagatgccggctggtatgtcaaggccgcctctgtcgaagccgatcggggaaaaggcataggcgttgccaaacacgccgccttcgtgttcggcggcgttccccttttctatacgccttgggcggacttcccgcttgacggcaaccgcaaaagcggactgctcgtcccgtccgtatctgccggttcggacggcgtttccctttccgtcccctattatttcaaccttgcccccaacttcgatgccactttcgcccccggcattatcggcgaacgcggcgcgacgtttgacggacaaatccgttacctgcgtcccgattacagcggacagaccgacctgacctggttgccgcacgataagaaaagcggcaggaacaaccgctatcaggcaaaatggcagcaccggcacgacatttccgacacgcttcaggcgggtgtcgatttcaaccaagtctccgacagcggctactaccgcgacttttacggcggcgaagaaatcgccggcaacgtcaacctcaaccgccgcgtatggctggattatggcggcagggcggcgggaggcagcctgaatgccggcctttcggttcagaaataccagacgctggcaaaccaaagcggctacaaagacgaaccttacgccatcatgccccgcctttctgccgattggcataaaaacgcaggcagggcgcaaatcggcgtgtccgcacaatttacccgcttcagccacgacggccgccaagacggcagccgactggtcgtgtatcccggtatcaaatgggatttcagcaacagctggggctacgtccgccccaaactcgggctgcacgccacttattacagcctcgacagtttcggcggcaaagcatcccgcagcgtcgggcgcgttttgcccgttgtcaatatcgacggcggcacaaccttcgaacgcaatacgcgcctgttcggcggcggagtcgtgcaaaccatcgagccgcgcctgttctacaactatattcctgccaaatctcaaaacgacctgcccaatttcgattcgtcggaaagcagcttcggctacgggcagcttttccgcgaaaacctctattacggcaacgaccgcatcaacgccgccaacagcctttccaccgccgtgcagagccgtattttggacggcgcgacgggggaggagcgtttccgcgccggtatcggtcagaaattctatttcaaggatgatgcggtgatgcttgacggcagcgtcggcaaaaatccgcgcagccgttccgactgggtggcattcgcctccggcggcataggcgggcgtttcaccctcgacagcagcatccactacaaccaaaacgacaaacgcgccgaacattacgccgtcggcgcaggctaccgccccgcccccggaaaagtgttgaacgcccgctacaaatacgggcgcaacgaaaaaatctacctgcaggcggacggttcctatttttacgacaaactcagccagctcgacctgtccgcacaatggccgctgacgcgcaacctgtctgccgtcgtccgctacaactacggttttgaagccaaaaaaccgatagaaatgcttgccggtgcagaatacaaaagcagttgcggctgctggggcgcgggcgtgtacgcccaacgctacgttaccggcgaaaacacctacaaaaacgccgtctttttttcacttcagttgaaagacctcagcagcgtcggcagaaaccccgcaggcaggatggatgtcgccgttcccggctacatccccgcccactctctttccgccggacgcaacaaacggccctga

SEQ ID NO: 41763 - protein, 801 aa, Neisseria gonorrhoeae
LARLFSLKPLVLALGFCFGTHCAADTVAAEEADGRVAEGGAQGASESAQASDLTLGSTCLFCSNESGSPERTEAAVQGSGEASVPEDYTRIVADRMEGQSKVKVRAEGSVIIERDGAVLNTDWADYDQSGDTVTVGDRFALQQDGTLIRGETLTYNLDQQTGEAHNVRMETEQGGRRLQSVSRTAEMLGEGRYKLTETQFNTCSAGDAGWYVKAASVEADRGKGIGVAKHAAFVFGGVPLFYTPWADFPLDGNRKSGLLVPSVSAGSDGVSLSVPYYFNLAPNFDATFAPGIIGERGATFDGQIRYLRPDYSGQTDLTWLPHDKKSGRNNRYQAKWQHRHDISDTLQAGVDFNQVSDSGYYRDFYGGEEIAGNVNLNRRVWLDYGGRAAGGSLNAGLSVQKYQTLANQSGYKDEPYAIMPRLSADWHKNAGRAQIGVSAQFTRFSHDGRQDGSRLVVYPGIKWDFSNSWGYVRPKLGLHATYYSLDSFGGKASRSVGRVLPVVNIDGGTTFERNTRLFGGGVVQTIEPRLFYNYIPAKSQNDLPNFDSSESSFGYGQLFRENLYYGNDRINAANSLSTAVQSRILDGATGEERFRAGIGQKFYFKDDAVMLDGSVGKNPRSRSDWVAFASGGIGGRFTLDSSIHYNQNDKRAEHYAVGAGYRPAPGKVLNARYKYGRNEKIYLQADGSYFYDKLSQLDLSAQWPLTRNLSAVVRYNYGFEAKKPIEMLAGAEYKSSCGCWGAGVYAQRYVTGENTYKNAVFFSLQLKDLSSVGRNPAGRMDVAVPGYIPAHSLSAGRNKRP

SEQ ID NO: 41764 - DNA, 2409 bp, Neisseria meningitidis
ttggctcgtttattttcactcaaaccactggtgctggcattgggcctctgcttcggcacgcattgcgccgccgccgatgccgttgcggcggaggaaacggacaatccgaccgccggagaaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaaccggacgaccctcaataccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgcatggaaatcgaacaaggcggacggcggctgcaaagcgtcagccgcaccgccgaaatgttgggcgaagggcattacaaactgacggaaacccaattcaacacctgttccgccggcgatgccggctggtatgtcaaggcagcctctgtcgaagccgatcgggaaaaaggcataggcgttgccaaacacgccgccttcgtgttcggcggcgttcccattttctacaccccttgggcggacttcccgcttgacggcaaccgcaaaagcggcctgcttgttccctcactgtccgccggttcggacggcgtttccctttccgttccctattatttcaaccttgcccccaatctcgatgccacgttcgcgcccagcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcatcggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctcatgccgcgcctttcggtcgagtggcgtaaaaacaccggcagggcgcaaatcggcgtgtccgcacaatttacccgattcagccacgacagccgccaagacggcagccgcctggtcgtctatcccgacatcaaatgggatttcagcaacagctggggctatgtccgtcccaaactcggactgcacgccacctattacagcctcaaccgcttcggcagccaagaagcccgacgcgtcagccgcactctgcccattgtcaacatcgacagcggcgcaacttttgagcggaatacgcggatgttcggcggagaagtcctgcaaaccctcgagccgcgcctgttctacaactatattcctgccaaatcccaaaacgacctgcccaatttcgattcgtcggaaagcagcttcggctacgggcagctctttcgcgaaaacctctattacggcaacgacaggattaacaccgcaaacagcctttccgccgccgtgcaaagccgtattttggacggcgcgacgggggaagagcgtttccgcgccggcatcggtcagaaattctatttcaaggatgatgcggtgatgcttgacggcagcgtcggcaaaaaaccgcgcaaccgttccgactgggtggcatttgcctccggcagcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatcaccgcccactctctttccgccggacgcaacaaacgaccctga

SEQ ID NO: 41765 - protein, 802 aa, Neisseria meningitidis
LARLFSLKPLVLALGLCFGTHCAAADAVAAEETDNPTAGESVRSVSEPIQPTSLSLGSTCLFCSNESGSPERTEAAVQGSGEASIPEDYTRIVADRMEGQSQVQVRAEGNVVVERNRTTLNTDWADYDQSGDTVTAGDRFALQQDGTLIRGETLTYNLEQQTGEAHNVRMEIEQGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPSVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSVEWRKNTGRAQIGVSAQFTRFSHDSRQDGSRLVVYPDIKWDFSNSWGYVRPKLGLHATYYSLNRFGSQEARRVSRTLPIVNIDSGATFERNTRMFGGEVLQTLEPRLFYNYIPAKSQNDLPNFDSSESSFGYGQLFRENLYYGNDRINTANSLSAAVQSRILDGATGEERFRAGIGQKFYFKDDAVMLDGSVGKKPRNRSDWVAFASGSIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYITAHSLSAGRNKRP

SEQ ID NO: 41766 - DNA, 2409 bp, Neisseria meningitidis
ttggctcgtttattttcactcaaaccactggtgctggcattgggcttctgtttcggcacgcattgcgccgccgccgatgccgttgcggcggaggaaacggacaatccgaccgccggaggaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaatcggacgaccctcaatgccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgtatggaaaccgaacacggcggacggcggctgcaaagcgtcagccgcaccgccgaaatgttgggcgaagggcattacaaactgacggaaacccaattcaacacctgttccgccggcgatgccggctggtatgtcaaggccgcttccgtcgaagccgatcgggaaaaaggcataggcgttgccaaacacgccgccttcgtgttcggcggcgttcccattttctacaccccttgggcggacttcccgcttgacggcaaccgcaaaagcggcctgctcgttccctcactgtccgccggttcggacggcgtttccctttccgttccctattatttcaaccttgcccccaatctcgatgccacgttcgcgcccggcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcaccggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctgatgccgcgcctttccgccgattggcgcaaaaacaccggcagggcgcaaatcggcgtgtccgcccaatttacccgcttcagccacgacagccgccaagacggcagccgcctcgtcgtctatcccgacatcaaatgggatttcagcaacagctggggttacgtccgtcccaaactcggactgcacgccacctattacagcctcaaccgcttcggcagccaagaagcccgacgcgtcagccgcactctgcccatcgtcaacatcgacagcggcatgaccttcgaacgcaatacgcggatgttcggcggcggagtcctgcaaaccctcgagccgcgcctgttctacaactatattcctgccaaatcccaaaacgacctgcccaatttcgattcgtcggaaagcagcttcggctacgggcagctttttcgtgaaaacctctattacggcaacgacaggattaacaccgcaaacagcctttccgccgccgtgcaaagccgtattttggacggcgcgacgggggaagagcgtttccgcgccggcatcgggcagaaattctacttcaaaaacgacgcagtcatgcttgacggcagtgtcggcaaaaaaccgcgcagccgttccgactgggtggcattcgcctccagcggcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatccccgcccactctctttccgccggacgcaacaaacggccctga

SEQ ID NO: 41767 - protein, 802 aa, Neisseria meningitidis
LARLFSLKPLVLALGFCFGTHCAAADAVAAEETDNPTAGGSVRSVSEPIQPTSLSLGSTCLFCSNESGSPERTEAAVQGSGEASIPEDYTRIVADRMEGQSQVQVRAEGNVVVERNRTTLNADWADYDQSGDTVTAGDRFALQQDGTLIRGETLTYNLEQQTGEAHNVRMETEHGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPGVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSADWRKNTGRAQIGVSAQFTRFSHDSRQDGSRLVVYPDIKWDFSNSWGYVRPKLGLHATYYSLNRFGSQEARRVSRTLPIVNIDSGMTFERNTRMFGGGVLQTLEPRLFYNYIPAKSQNDLPNFDSSESSFGYGQLFRENLYYGNDRINTANSLSAAVQSRILDGATGEERFRAGIGQKFYFKNDAVMLDGSVGKKPRSRSDWVAFASSGIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYIPAHSLSAGRNKRP

SEQ ID NO: 41768 - DNA, 327 bp, Neisseria gonorrhoeae; identical to SEQ ID NO: 41342

SEQ ID NO: 41769 - protein, 108 aa, Neisseria gonorrhoeae; identical to SEQ ID NO: 41343

SEQ ID NO: 41770 - DNA, 327 bp, Neisseria meningitidis; identical to SEQ ID NO: 41344

SEQ ID NO: 41771 - protein, 108 aa, Neisseria meningitidis; identical to SEQ ID NO: 41345

SEQ ID NO: 41772 - DNA, 327 bp, Neisseria meningitidis; identical to SEQ ID NO: 41346

SEQ ID NO: 41773 - protein, 108 aa, Neisseria meningitidis; identical to SEQ ID NO: 41347

SEQ ID NO: 41774 - DNA, 1623 bp, Neisseria meningitidis
atgcaagtaaatattcagattccctgtatgctgtacagacgcgggagtgttaagccccccttgtttgaagctccgcggctcctgccgagcttcaccgaccccgttgtgcccaagctctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaaccggtgataggttttatttagatggccaacataaaaatcatttagaggtttttgataaaaatgggaactttaagtttgttctaaatatggatggttcgcttaaccaaatgaaaactggggcagcaaaaggtcgtaaattaaacttaaaatag

SEQ ID NO: 41775 - protein, 540 aa, Neisseria meningitidis
MQVNIQIPCMLYRRGSVKPPLFEAPRLLPSFTDPVVPKLSAPGGYIVDIPKGNLKTEIEKLAKQPEYAYLKQLQVAKNVNWNQVQLAYDKWDYKQEGLTRAGAAIIALAVTVVTAGAGVGAALGLNGAAAAAADAAFASLASQASVSLINNKGDVGKTLKELGRSRTVKNLVVAAATAGVSNKLGASSLATWSETPWVNNLNVNLANAGSAALINTAVNGGSLKDNLEANILAALVNTAHGEAASKIKGLDQHYVAHKIAHAVAGCAAAAANKGKCQDGAIGAAVGEIVGEALVKNTDFSDMTPEQLDLEVKKITAYAKLAAGTVAGVTGGDVNTAAQTAQNAVENNAVKAVVTAAKVVYKVARKGLKNGKINVRDLKQTLKDEGYNLADNLTTLFDETLDWNDAKAVIDIVVGTELNRANKGEAAQKVKEVLEKNRPYIPNKGAVPNMSTYMKNNPFGKQLAQISEKTTLPTQQGQSVFLVKRNQGLLKTGDRFYLDGQHKNHLEVFDKNGNFKFVLNMDGSLNQMKTGAAKGRKLNLK

SEQ ID NO: 41776 - DNA, 1095 bp, Neisseria meningitidis
atgagcatgaaacactttccagccaaagtactgaccacagccatccttgccactttctgtagcggcgcactggcagccacaagcgacgacgatgttaaaaaagctgccactgtggccattgttgctgcctacaacaatggccaagaaatcaacggtttcaaagctggagagaccatctacgacattggtgaagacggcacaattacccaaaaagacgcaactgcagccgatgttgaagccgacgactttaaaggtctgggtctgaaaaaagtcgtgactaacctgaccaaaaccgtcaatgaaaacaaacaaaacgtcgatgccaaagtaaaagctgcagaatctgaaatagaaaagttaacaaccaagttagcagacactgatgccgctttagcagatactgatgccgctctggatgaaaccaccaacgccttgaataaattgggagaaaatataacgacatttgctgaagagactaagacaaatatcgtaaaaattgatgaaaaattagaagccgtggctgataccgtcgacaagcatgccgaagcattcaacgatatcgccgattcattggatgaaaccaacactaaggcagacgaagccgtcaaaaccgccaatgaagccaaacagacggccgaagaaaccaaacaaaacgtcgatgccaaagtaaaagctgcagaaactgcagcaggcaaagccgaagctgccgctggcacagctaatactgcagccgacaaggccgaagctgtcgctgcaaaagttaccgacatcaaagctgatatcgctacgaacaaagctgatattgctaaaaactcagcacgcatcgacagcttggacaaaaacgtagctaatctgcgcaaagaaacccgccaaggccttgcagaacaagccgcgctctccggcctgttccaaccttacaacgtgggtcggttcaatgtaacggctgcagtcggcggctacaaatccgaatcggcagtcgccatcggtaccggcttccgctttaccgaaaactttgccgccaaagcaggcgtggcagtcggcacttcgtccggttcttccgcagcctaccatgtcggcgtcaattacgagtggtaa

SEQ ID NO: 41777 - protein, 364 aa, Neisseria meningitidis
MSMKHFPAKVLTTAILATFCSGALAATSDDDVKKAATVAIVAAYNNGQEINGFKAGETIYDIGEDGTITQKDATAADVEADDFKGLGLKKVVTNLTKTVNENKQNVDAKVKAAESEIEKLTTKLADTDAALADTDAALDETTNALNKLGENITTFAEETKTNIVKIDEKLEAVADTVDKHAEAFNDIADSLDETNTKADEAVKTANEAKQTAEETKQNVDAKVKAAETAAGKAEAAAGTANTAADKAEAVAAKVTDIKADIATNKADIAKNSARIDSLDKNVANLRKETRQGLAEQAALSGLFQPYNVGRFNVTAAVGGYKSESAVAIGTGFRFTENFAAKAGVAVGTSSGSSAAYHVGVNYEW

SEQ ID NO: 41778 - DNA, 1269 bp, Neisseria meningitidis
ttgactaacagggggggagcgaaattaaaaaccarttccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggargtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaa

SEQ ID NO: 41779 - protein, 422 aa, Neisseria meningitidis
  misc_feature (12)..(12): Xaa can be any naturally occurring amino acid
  misc_feature (125)..(125): Xaa can be any naturally occurring amino acid
LTNRGGAKLKTXSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGXQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKKLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 41780 - DNA, 1269 bp, Neisseria meningitidis
ttgactaacagggggggagcgaaattaaaaaccaattccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaacgcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaa

SEQ ID NO: 41781 - protein, 422 aa, Neisseria meningitidis
LTNRGGAKLKTNSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGGQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKTLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 41782 - DNA, 863 bp, Neisseria gonorrhoeae
atggacggcgcacaaccgaaaacaaatttttttgaacgcctgattgcccgactcgcccgcgaacccgattccgccgaagacgtattaaacctgcttcggcaggcgcacgaacaggaagtttttgatgccgacacactgacccggctggaaaaagtattggactttgccgagctggaagtgcgcgatgcgatgattacgcgcagccgcatgaacgtattgaaagaaaacgacagcatcgaacgcatcaccgcctacgtcatcgataccgcccattcgcgcttccccgtcatcggcgaagacaaagacgaagttttgggcattttgcacgccaaagacctgctcaaatatatgttcaaccccgagcagttccacctgaaatccgtcttgcgccctgccgttttcgtgcccgaaggcaaatctttgaccgcccttttaaaagagttccgcgaacagcgcaaccatatggcaatcgtcatcgacgaatacggcggcacgtcgggtttggtcacctttgaagacatcatcgagcaaatcgtcggtgacatcgaagacgagtttgacgaagacgaaagcgccgacgacatccactccgtttccgccgaacgctggcgcatccacgcggctaccgaaatcgaagacatcaacgcctttttcggtacggaatacggcagcgaagaagccgacaccatcggcggcttggtcattcaggaattgggacacctgcccgtgcgcggcgaaaaagtccttatcggcggtttgcagttcaccgtcgcccgcgccgacaaccgccgcctgcacacgctgatggcgacccgcgtgaagtaagcagagcctgcccgcaccgccgtttctgcacagtttag

SEQ ID NO: 41783 - protein, 274 aa, Neisseria gonorrhoeae
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIGGLVIQELGHLPVRGEKVLIGGLQFTVARADNRRLHTLMATRVK

SEQ ID NO: 41784 - DNA, 825 bp, Neisseria meningitidis
atggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttcmgaacgctggcgcatccatgcagctaccgaaatcgaagacatcaacaccttcttcggcacggaatacagcakcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaa

SEQ ID NO: 41785 - protein, 274 aa, Neisseria meningitidis
  misc_feature (224)..(224): Xaa can be any naturally occurring amino acid
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSXEEADTIGGLVIQELGHLPVRGEKVLIGGLQFTVARADNRRLHTLMATRVK

SEQ ID NO: 41786 - DNA, 825 bp, Neisseria meningitidis
atggacggcgcacaaccgaaaacaaatttttttgaacgcctgattgcccgactcgcccgcgaacccgattccgccgaagacgtattgaccctgttgcgccaagcgcacgaacaggaagtatttgatgcggatacgcttttaagattggaaaaagtcctcgatttttctgatttggaagtgcgcgacgcgatgattacgcgcagccgtatgaacgttttaaaagaaaacgacagcatcgaacgcatcaccgcctacgttatcgataccgcccattcgcgcttccccgtcatcggtgaagacaaagacgaagttttgggtattttgcacgccaaagacctgctcaaatatatgttcaaccccgagcagttccacctcaaatcgatattgcgccctgccgtcttcgtccccgaaggcaaatcgctgaccgcccttttaaaagagttccgcgaacagcgcaaccatatggcaatcgtcatcgacgaatacggcggcacgtcgggtttggtaacttttgaagacatcatcgagcaaatcgtcggcgacatcgaagatgagtttgacgaagacgaaagcgcggacaacatccacgccgtttccgccgaacgctggcgcatccacgcggctaccgaaatcgaagacatcaacgcctttttcggcacggaatacagcagcgaagaagccgacaccatcggcggcctggtcattcaggaattgggacacctgcccgtgcgcggcgaaaaagtccttatcggcggtttgcagttcaccgtcgcccgcgccgacaaccgccgcctgcatacgctgatggcgacccgcgtgaagtaa

SEQ ID NO: 41787 - protein, 274 aa, Neisseria meningitidis
MDGAQPKTNFFERLIARLAREPDSAEDVLTLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGDIEDEFDEDESADNIHAVSAERWRIHAATEIEDINAFFGTEYSSEEADTIGGLVIQELGHLPVRGEKVLIGGLQFTVARADNRRLHTLMATRVK

SEQ ID NO: 41788 - DNA, 801 bp, Neisseria gonorrhoeae
atgaaaaaatggattgccgccgcccttgcctgttccgcactcgcgctgtctgcctgcggcggtcagggcaaagatgccgccgcgcctgccgccaaccccggcaaagtgtaccgcgtggcttccaacgccgagtttgccccctttgaatctttagactcgaaaggcaatgtcgaaggtttcgacgtggatttgatgaacgcgatggcgaaggcgggcaattttaaaatcgaattcaaacaccagccgtgggacagccttttccccgccttgaacaacggcgatgcggacgttgtgatgtcgggcgtaaccattaccgacgaccgcaaacagtctatggatttcagcgacccgtattttgaaatcacccaagtcgtcctcgttccgaaaggcaaaaaagtatcttcttccgaagatttgaaaaagatgaacaaagtcggcgtggttaccggccacacgggcgatttctccgtttccaaactcttgggcaacgacaatccgaaaatcgcgcgcttcgaaaacgtccccctgattatcaaagaactggaaaacggcggcttggattccgtggtcagcgacagcgcggtcatcgccaattatgtgaaaaacaacccggccaaaggaatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatctacgccaaatattttgccaaagagggcggacaggctgcgaaataa

SEQ ID NO: 41789 - protein, 266 aa, Neisseria gonorrhoeae
MKKWIAAALACSALALSACGGQGKDAAAPAANPGKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKKMNKVGVVTGHTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEGGQAAK

SEQ ID NO: 41790 - DNA, 801 bp, Neisseria meningitidis
atgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataa

SEQ ID NO: 41791 - protein, 266 aa, Neisseria meningitidis
MKKWIAAALACSALALSACGGQGKDTAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKNMNKVGVVTGYTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEDGQAAK

SEQ ID NO: 41792 - DNA, 801 bp, Neisseria meningitidis
atgaaaaaatggattgccgccgcccttgcctgttccgcgctcgcgctgtctgcctgcggcggtcagggtaaagatgccgccgcgcccgccgcaaatcccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttgaacaacggcgatgcggacgttgtgatgtcgggcgtaaccattaccgacgaccgcaaacagtctatggacttcagcgacccgtattttgaaatcacccaagtcgtcctcgttccgaaaggcaaaaaaatatcttcttccgaagatttgaaaaacatgaacaaagtcggcgtggtaaccggctacacgggcgatttctccgtatccaaactcttgggcaacgacaacccgaaaatcgcgcgctttgaaaacgttcccctgattatcaaagaactggaaaacggcggcttggattccgtggtcagcgacagcgcagtcatcgccaattatgtgaaaaacaatccgaccaaagggatggacttcgttaccctgcccgacttcaccaccgaacactacggcatcgcggtacgcaaaggcgacgaagcaaccgtcaaaatgctgaacgatgcgttgaaaaaagtacgcgaaagcggcgaatacgacaaaatctacgccaaatattttgcaaaagaagacggacaggccgcaaaataa

SEQ ID NO: 41793 - protein, 266 aa, Neisseria meningitidis
MKKWIAAALACSALALSACGGQGKDAAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKISSSEDLKNMNKVGVVTGYTGDFSVSKLLGNDNPKIARFENVPLIIKELENGGLDSVVSDSAVIANYVKNNPTKGMDFVTLPDFTTEHYGIAVRKGDEATVKMLNDALKKVRESGEYDKIYAKYFAKEDGQAAK

SEQ ID NO: 41794 - DNA, 1635 bp, Neisseria gonorrhoeae
atcgcatcgcaaaaccttcgattcgacaatcgattcctccaaaaaatggtcaacggcgtgaatattttgccggccgccgattgggtagccttgggcgccaaaggccgcaacgtggtggttgaccgcgctttcggcggcccgcacatcaccaaagacggcgtaaccgtcgccaaagaaatcgaactgaaagacaagtttgaaaatatgggcgcgcaaatggtaaaagaagtcgcgtccaaaaccaacgacgtagccggcgacggtacgactaccgccaccgtattggcacaatccatcgttgccgaaggcatgaaatacgttaccgccggcatgaacccgaccgatctgaaacgcggcatcgacaaagccgttgccgctttggttgaagagctgaaaaacatcgccaaaccttgcgatacttccaaagaaatcgcccaagtcggctcgatttccgccaactccgacgaacaagtcggcgcgattatcgccgaagcgatggaaaaagtcggcaaagaaggcgtgattaccgttgaagacggcaaatctttggaaaacgagctggacgtggttgaaggtatgcagttcgaccgcggctacctgtccccttactttatcaacgacgcggaaaaacaaatcgccggtctggacaatccgtttgttttgctgttcgacaaaaaaatcagcaacatccgcgacctgctgcccgtgttggaacaagtggcgaaagccagccgcccgctgttgattatcgctgaagacgtagaaggcgaagccttggcgactttggtcgtgaacaacatccgcggcatcctgaaaaccgttgccgtcaaagcccccggcttcggcgaccgccgcaaagcgatgctgcaagacatcgccatcctgaccggcggcgtagtgatttccgaagaagtcggcctgtctttggaaaaagcgactttggacgacttgggtcaaaccaaacgcatcgaaatcggtgaagaaaacactaccgtcatcgacggcttcggcgacgcagcccaaatcgaagcgcgtgttgccgaaatccgccaacaaatcgaaaccgcgaccagcgattacgacaaagaaaaactgcaagagcgcgttgccaaactggcaggaggcgtggcagtgatcaaagtcggcgcggcgaccgaagtcgaaatgaaagagaaaaaagaccgcgtggaagacgcgctgcacgctacccgcgcagccgttgaagaaggcgtggttgcaggcggcggcgtagccctgttgcgcgcccgtgccgctttggaaaacctgcacaccggcaatgccgaccaagacgcaggcgtacaaatcgtattgcgcgccgttgagtctccgctgcgccaaatcgttgccaacgcaggcggagaacccagcgtggtggtgaacaaagtgttggaaggcaaaggcaactacggttacaacgcaggctccggcgaatacggcgacatgatcggaatgggcgtactcgaccctgccaaagtaacccgttccgcgctgcaacacgccgcgtctatcgccggtctgatgctgacgaccgactgcatgattgccgaaatccctgaagaaaaaccggctgtgcccgatatggggggaatgggcggtatgggcggcatgatgtaa

SEQ ID NO: 41795 - protein, 544 aa, Neisseria gonorrhoeae
IASQNLRFDNRFLQKMVNGVNILPAADWVALGAKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQTKRIEIGEENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIGMGVLDPAKVTRSALQHAASIAGLMLTTDCMIAEIPEEKPAVPDMGGMGGMGGMM

SEQ ID NO: 41796 - DNA, 1635 bp, Neisseria meningitidis
atggcagcaaaagacgtacagttcggcaatgaagtccgtcaaaaaatggtaaacggcgtgaacattctggcaaacgccgtccgcgtaaccttgggccccaaaggtcgcaacgtagtcgttgaccgcgcattcggcggcccgcacatcaccaaagacggcgtaaccgtcgccaaagaaatcgaactgaaagacaagtttgaaaatatgggcgcgcaaatggtgaaagaagttgcgtccaaaaccaacgacgtggcaggcgacggtacgactaccgccaccgtactggcgcaatccatcgttgccgaaggtatgaaatatgttaccgcaggtatgaatccgaccgacctgaaacgcggtatcgataaagccgtcgccgctttggttgacgaactgaaaaacatcgccaaaccttgcgacacttctaaagaaatcgcccaagtcggctctatttccgccaactccgacgaacaagtcggcgcgattatcgccgaagcgatggaaaaagtcggcaaagaaggcgtgattaccgttgaagacggcaagtctttggaaaacgagctggacgtagttgaaggtatgcagttcgaccgcggctacctgtctccttacttcatcaacgatgcggaaaaacaaatcgctgctttggacaatccgtttgtattgttgttcgacaaaaaaatcagcaacatccgcgacctgctgcctgttttggaacaagtggcaaaagccagccgtccgctgttgattatcgctgaagacgtagaaggcgaagccttggcgactttggtcgtgaacaacatccgaggcatcctgaaaaccgttgccgtcaaagcccctggcttcggcgaccgccgcaaagcgatgttgcaagacatcgccatcctgaccggcggcgtggtgatttccgaagaagtcggtctgtctttggaaaaagcgactttggacgacttgggtcaagccaaacgcatcgaaatcggtaaagaaaacaccaccatcatcgacggctttggcgacgcagcccaaatcgaagcgcgtgttgccgaaatccgccaacaaatcgaaaccgcaaccagcgattacgacaaagaaaaactgcaagagcgcgtggctaaattggcaggcggcgtggcagtcatcaaagtcggtgccgcgaccgaagtcgaaatgaaagagaaaaaagaccgcgtggaagacgcgctgcacgctacccgcgcagccgttgaagaaggcgtggttgcaggcggcggcgtagccctgttgcgtgcccgtgctgctttggaaaacctgcacaccggcaatgccgaccaagacgcaggcgtacaaatcgtcttgcgcgccgttgagtctccgctgcgccaaatcgttgccaacgcaggcggcgaacccagcgtggttgtgaacaaagtattggaaggcaaaggcaactacggttacaacgctggcagcggcgaatacggcgatatgatcgaaatgggcgtactcgaccccgccaaagtaacccgttctgcgctgcaacacgccgcatctatcgccggcttgatgctgaccactgattgcatgatcgctgaaatccccgaagacaaaccggctgtgcctgatatgggcggcatgggtggtatgggcggcatgatgtaa

SEQ ID NO: 41797 - protein, 1635 aa, Neisseria meningitidis
ATGGCAGCAAAAGACGTACAGTTCGGCAATGAAGTCCGTCAAAAAATGGTAAACGGCGTGAACATTCTGGCAAACGCCGTCCGCGTAACCTTGGGCCCCAAAGGTCGCAACGTAGTCGTTGACCGCGCATTCGGCGGCCCGCACATCACCAAAGACGGCGTAACCGTCGCCAAAGAAATCGAACTGAAAGACAAGTTTGAAAATATGGGCGCGCAAATGGTGAAAGAAGTTGCGTCCAAAACCAACGACGTGGCAGGCGACGGTACGACTACCGCCACCGTACTGGCGCAATCCATCGTTGCCGAAGGTATGAAATATGTTACCGCAGGTATGAATCCGACCGACCTGAAACGCGGTATCGATAAAGCCGTCGCCGCTTTGGTTGACGAACTGAAAAACATCGCCAAACCTTGCGACACTTCTAAAGAAATCGCCCAAGTCGGCTCTATTTCCGCCAACTCCGACGAACAAGTCGGCGCGATTATCGCCGAAGCGATGGAAAAAGTCGGCAAAGAAGGCGTGATTACCGTTGAAGACGGCAAGTCTTTGGAAAACGAGCTGGACGTAGTTGAAGGTATGCAGTTCGACCGCGGCTACCTGTCTCCTTACTTCATCAACGATGCGGAAAAACAAATCGCTGCTTTGGACAATCCGTTTGTATTGTTGTTCGACAAAAAAATCAGCAACATCCGCGACCTGCTGCCTGTTTTGGAACAAGTGGCAAAAGCCAGCCGTCCGCTGTTGATTATCGCTGAAGACGTAGAAGGCGAAGCCTTGGCGACTTTGGTCGTGAACAACATCCGAGGCATCCTGAAAACCGTTGCCGTCAAAGCCCCTGGCTTCGGCGACCGCCGCAAAGCGATGTTGCAAGACATCGCCATCCTGACCGGCGGCGTGGTGATTTCCGAAGAAGTCGGTCTGTCTTTGGAAAAAGCGACTTTGGACGACTTGGGTCAAGCCAAACGCATCGAAATCGGTAAAGAAAACACCACCATCATCGACGGCTTTGGCGACGCAGCCCAAATCGAAGCGCGTGTTGCCGAAATCCGCCAACAAATCGAAACCGCAACCAGCGATTACGACAAAGAAAAACTGCAAGAGCGCGTGGCTAAATTGGCAGGCGGCGTGGCAGTCATCAAAGTCGGTGCCGCGACCGAAGTCGAAATGAAAGAGAAAAAAGACCGCGTGGAAGACGCGCTGCACGCTACCCGCGCAGCCGTTGAAGAAGGCGTGGTTGCAGGCGGCGGCGTAGCCCTGTTGCGTGCCCGTGCTGCTTTGGAAAACCTGCACACCGGCAATGCCGACCAAGACGCAGGCGTACAAATCGTCTTGCGCGCCGTTGAGTCTCCGCTGCGCCAAATCGTTGCCAACGCAGGCGGCGAACCCAGCGTGGTTGTGAACAAAGTATTGGAAGGCAAAGGCAACTACGGTTACAACGCTGGCAGCGGCGAATACGGCGATATGATCGAAATGGGCGTACTCGACCCCGCCAAAGTAACCCGTTCTGCGCTGCAACACGCCGCATCTATCGCCGGCTTGATGCTGACCACTGATTGCATGATCGCTGAAATCCCCGAAGACAAACCGGCTGTGCCTGATATGGGCGGCATGGGTGGTATGGGCGGCATGATGTAA

SEQ ID NO: 41798 - DNA, 1635 bp, Neisseria meningitidis
atggcagcaaaagacgtacaattcggcaatgaagtccgccaaaaaatggtaaacggcgtgaacattttggcaaacgccgtgcgcgtaaccttgggtcccaaaggccgcaacgtggtggttgaccgcgctttcggcggcccgcacatcaccaaagacggcgtaaccgtcgccaaagaaatcgaactgaaagacaagtttgaaaatatgggcgcgcaaatggtgaaagaagtcgcgtccaaaaccaacgacgtggcgggcgacggtacgactaccgccaccgtattggcgcaatccatcgttgccgaaggtatgaaatacgttaccgccggtatgaacccgaccgacctgaaacgcggtatcgacaaagccgtcgccgctttggttgaagagctgaaaaacatcgccaaaccttgcgacacttctaaagaaatcgcccaagtcggctctatttccgccaactctgacgaacaagtcggcgcgattattgccgaagcgatggaaaaagtcggcaaagaaggcgtgattaccgttgaagacggcaaatctttggaaaacgagctggacgtggttgaaggtatgcaattcgaccgcggctacctgtctccttacttcatcaacgatgcggaaaaacaaatcgccggcttggacaatccgtttgtattgctgttcgacaaaaaaatcagcaatatccgcgacctgctgcctgttttggaacaagtggccaaagccagccgtccgctgttgattatcgctgaagacgtagaaggcgaagccttggcgactttggtcgtgaacaacatccgcggcattctgaaaaccgttgccgttaaagctccgggcttcggcgaccgccgcaaagcgatgctgcaagacatcgctatcctgaccggcggcacagtgatttccgaagaagtcggcctgtctttggaaaaagcgactttggacgacttgggtcaggccaaacgcatcgaaatcggtaaagaaaacaccaccatcatcgacggcttcggcgacgcagcccaaatcgaagcgcgtgttgccgaaatccgccaacaaatcgaaaccgcaaccagcgattacgacaaagaaaaactgcaagagcgcgttgccaaactggcaggcggcgtggcagtaatcaaagtcggtgccgcgaccgaagtggaaatgaaagagaaaaaagaccgcgtggaagacgcgctgcacgctacccgcgcagccgttgaagaaggcgtggttgcaggcggcggcgtagccctgttgcgcgcccgtgccgctctggaaaacctgcacaccggcaatgcagaccaagacgcaggcgtacaaatcgtcttgcgcgccgttgagtctccgctgcgccaaatcgttgccaacgcaggcggcgaacccagcgtggttgtgaacaaagtgttggaaggcaaaggcaactatggttacaacgctggcagcggcgaatacggcgacatgatcgaaatgggcgtactcgaccccgccaaagtaacccgttccgcgctgcaacacgccgcgtctatcgccggcctgatgctgaccacagactgcatgattgctgaaatccctgaagacaaaccggctatgcctgatatgggcggcatgggtggtatgggcggcatgatgtaa

SEQ ID NO: 41799 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGTVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAMPDMGGMGGMGGMM

SEQ ID NO: 41800 - DNA, 1500 bp, Neisseria gonorrhoeae
gtgttcaaaaaataccaatacttcgctttggcggcactgtgtgccgccttgctggcaggctgcgaaaaggcaggcagctttttcggtgcggacaaaaaagaagcatccttcgtagaacgcatcgaacacaccaaagacgacggcagtgtcagtatgctgctgcccgactttgcccaactggttcaaagcgaaggcccggcagtcgtcaatattcaggcagcccccgccccgcgcacccaaaacggcagcggcaatgccgaaaccgattccgacccgcttgccgacagcgacccgttctacgaatttttcaaacgcctcgtcccgaacatgcccgaaatcccccaagaagaagcagatgacggcggattgaacttcggttcgggcttcatcatcagcaaaaacggctacatcctgaccaatacccacgtcgttgccggtatgggcagtatcaaagtcctgctcaacgacaagcgcgaatataccgccaaactcatcggttcggatgtccaatccgatgtcgcccttctgaaaatcgacgcaacggaagagctacccgtcgtcaaaatcggcaatcccaaaaatttgaaaccgggcgaatgggtcgctgccatcggcgcgcccttcggctttgacaacagcgtgaccgccggcatcgtgtccgccaaaggcagaagcctgcccaacgaaagctacacacccttcatccaaaccgacgttgccatcaatccgggcaattccggcggcccgctgttcaacttaaaaggacaggtcgtcggcatcaattcgcaaatatacagccgcagcggcggattcatgggcatctcctttgccatcccgattgacgttgccatgaatgtcgccgaacagctgaaaaacaccggcaaagtccaacgcggacaactgggcgtgattattcaggaagtatcctacggtttggcacagtcgttcggtctggataaagccagcggcgcattgattgccaaaatccttcccggcagccccgcagaacgtgccggcctgcaggcgggcgacatcgtcctcagcctcgacggcggagaaatacgttcttccggcgaccttcccgtcatggtcggcgccattacgccgggaaaagaagtcagcctcggcgtatggcgcaaaggcgaagaaatcacaatcaaagccaagctgggcaacgccgccgagcataccggcgcatcatccaaaacagatgaagccccctacaccgaacagcaatccggtacgttctcggtcgaatccgcaggcattacccttcagacacataccgacagcagcggcaaacacctcgtcgtcgtacgggtttccgacgcggcagaacgcgcaggcttaaggcgcggcgacgaaatcctcgcggtcgggcaagtccccgtcaatgacgaagccggtttccgcaaagctatggacaaggcaggcaaaaacgtccccctgctggtcatgcgccgtggcaacacgctgttcatcgcattaaacctgcaataa

SEQ ID NO: 41801 - protein, 499 aa, Neisseria gonorrhoeae
VFKKYQYFALAALCAALLAGCEKAGSFFGADKKEASFVERIEHTKDDGSVSMLLPDFAQLVQSEGPAVVNIQAAPAPRTQNGSGNAETDSDPLADSDPFYEFFKRLVPNMPEIPQEEADDGGLNFGSGFIISKNGYILTNTHVVAGMGSIKVLLNDKREYTAKLIGSDVQSDVALLKIDATEELPVVKIGNPKNLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKASGALIAKILPGSPAERAGLQAGDIVLSLDGGEIRSSGDLPVMVGAITPGKEVSLGVWRKGEEITIKAKLGNAAEHTGASSKTDEAPYTEQQSGTFSVESAGITLQTHTDSSGKHLVVVRVSDAAERAGLRRGDEILAVGQVPVNDEAGFRKAMDKAGKNVPLLVMRRGNTLFIALNLQ

SEQ ID NO: 41802 - DNA, 1500 bp, Neisseria meningitidis
gtgttcaaaaaataccaatacctcgctttggcagcactgtgtgcagcctcgctggcaggctgcgacaaggcaggcagcttcttcgtggcggacaaaaaagaagcatccttcgtagaacgcatcgaacacaccaaagacgacggcagcgtcagtatgctgctgcccgactttgcccaactggttcaaagtgaaggtccggcagtcgtcaatattcaggcagcccccgccccgcgcacccaaaacggcagcggcaatgccgaaaacgattccgacccgattgccgacaacgacccgttctacgaatttttcaaacgcctcgtcccgaatatgcccgaaatcccccaagaagaagcagatgacggcggattgaacttcggttcgggcttcatcatcagcaaagacggctacatcctgaccaatacccacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcatcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcaggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 41803 - protein, 499 aa, Neisseria meningitidis
VFKKYQYLALAALCAASLAGCDKAGSFFVADKKEASFVERIEHTKDDGSVSMLLPDFAQLVQSEGPAVVNIQAAPAPRTQNGSGNAENDSDPIADNDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLQAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 41804 - DNA, 1500 bp, Neisseria meningitidis
  misc_feature (363)..(363): n is a, c, g, or t
  misc_feature (652)..(652): n is a, c, g, or t
gtgttcaaaaaataccaatacctcgctttggcagcactgtgtgccgcctcgctggcaggctgcgacaaagccggcagctttttcggtgcggacaaaaaagaagcatcctttgtagaacgcatcaaacacaccaaagacgacggcagcgtcagtatgctgctgcccgactttgtccaactggttcaaagcgaaggcccggcagtcgtcaatattcaggcagcccccgccccgcgcacccaaaacggcagcagcaatgccgaaaccgattccgacccgcttgccgacagcgacccgttctacgaatttttcaaacgcctcgtcccgaacatgcccgaaatcccccaagaagaagcagatgacggnggattgaacttcggttcgggcttcatcatcagcaaagacggctatattctgaccaatacgcacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcntcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcgggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 41805 - protein, 499 aa, Neisseria meningitidis
  misc_feature (218)..(218): Xaa can be any naturally occurring amino acid
VFKKYQYLALAALCAASLAGCDKAGSFFGADKKEASFVERIKHTKDDGSVSMLLPDFVQLVQSEGPAVVNIQAAPAPRTQNGSSNAETDSDPLADSDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGXVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLRAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 41806 - DNA, 1527 bp, Neisseria gonorrhoeae
atgaaaacacgcagcctcatttcccttttatgcctccttctctgttcatgttcttcatggttgcccccactggaagaacggacggaaagccgtcattttaatacttccaaacctgtcctcctggacaacatcctgcaaatccggcacacccctcataacaacgggctatccgacatctacctgctcgacgacccccacgaagcctttgccgcccgcgccgcccttatcgaatctgccgaacacagcctcgatttgcaatactacatttggcgcaacgacatttccggcaggctgctgttcaacctcatgtaccttgccgcagaacgcggcgtgcgcgtacgcctgctgttggacgacaacaacacgcgcggcttggacgatctcctgctcgccctcgacagccatcccaatatctaagtgcgcctgttcaaccccttcgtcctacgcaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacatccagacacgcgctcctgcgctaccgcgaaaccgtcgaacagtcgcccctctaccaaaaaatacagacgggacgcatcgactggcagagcgtccaaacccgcctgatcagcgacagccctgcaaaaggactcgaccgcgaccgccgcaaaccgccgattgccgggaggctgcaagacgcgctcaaacagcccgaaaaaagcgtctatctggtttcaccctatttcgtccctacaaaatccggcacagacgcactggcaaaactggtgcaggacggcatagacgttaccgtcctgaccaactcgctacaggcgaccgacgttgccgccgtccattccggctacgtcaaataccgaaaaccgctgctcaaagccggcatcaaactctacgagctgcaacccaaccatgccgtccccgccacaaaagacaaaggcctgaccggcagctccgtaaccagcctgcatgccaaaaccttcattgtggacggcaaacgcatcttcatcggctcattcaacctcgacccccgttccgcacggctcaataccgaaatgggcgtcgtcatcgaaagccccaaaatcgcagaacagatggagcgcaccctcgccgataccacacccgaatacgcctaccgcgttaccctcgacaaacacaaccgcctgcaatggcacgatcccgccacccgaaaaacctacccgaacgaacccgaagccaaactttggaaacgcatcgccgcaaaaatcctatccctgctgcccatcgaaggtttattatag

SEQ ID NO: 41807 - protein, 507 aa, Neisseria gonorrhoeae
MKTRSLISLLCLLLCSCSSWLPPLEERTESRHFNTSKPVLLDNILQIRHTPHNNGLSDIYLLDDPHEAFAARAALIESAEHSLDLQYYIWRNDISGRLLFNLMYLAAERGVRVRLLLDDNNTRGLDDLLLALDSHPNIVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDSPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPEYAYRVTLDKHNRLQWHDPATRKTYPNEPEAKLWKRIAAKILSLLPIEGLL

SEQ ID NO: 41808 - DNA, 1527 bp, Neisseria meningitidis
atgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggcaggctgctgttcaacctcgtgtaccttgccgcagaacgcggtgtgcgcgtacgcctgctgttggacgacaacaacacgcgcggattggacgacctcctgcttgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgatttggacatcctcgccaccggcagcgtcgtcggcgaagtatcgcacgacttcgaccgctactgggcaagccattccgcccacaacgccacgcgcatcatccgcagcggcgacatcggcaagggtcttcaagcactcggatacaacgacgaaacgtccagacacgcgctcctgcgctaccgcgaaaccgtcgaacagtcgcccctctaccaaaaaatacagacaggatgcatcgactggcagagcgtccgaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgttcccacaaaatccggcacagacgcactggcaaaactggtgcaggacggcatagacgttaccgttctgaccaactcgctgcaggcgaccgacgttgccgccgtccattccggctatgtcaaataccgaaaaccgctgctcaaagccggcatcaaactctacgagctgcaacccaaccatgccgtccccgccacaaaagacaaaggcctgaccggcagctccgtaaccagcctgcacgccaaaaccttcattgtggacggcaaacgcatcttcatcggttcgttcaacctcgacccccgttccgcgcgtctcaacaccgaaatgggcgttgttatcgaaagccccaaaatcgcagaacagatggagcgcacccttgccgataccacacccgcctacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaggtttattatag

SEQ ID NO: 41809 - protein, 508 aa, Neisseria meningitidis
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGDIGKGLQALGYNDETSRHALLRYRETVEQSPLYQKIQTGCIDWQSVRTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPAYAYRVTLDRHNRLQWHDPATRKTYPNEPEAKLWKRIAAKILSLLPIEGLL

SEQ ID NO: 41810 - DNA, 1527 bp, Neisseria meningitidis
atgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggccgactgctgttcaacctcgtgtaccttgccgcagaacgcggtgtgcgcgtacgcctgctgttggacgacaacaacacgcgcggattggacgacctcctgctcgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacgtccagacacgcgctcctgcgctaccgcgaaaccgtcgaacagtcgcccctctaccaaaaaatacagacaggacgcatcgactggcagagcgtccaaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgtccccacaaaatccggcacagacgcactggcaaaactggtgcaggacggcatagacgttaccgtcctgaccaactcgctacaggcgaccgacgttgccgccgtccattccggctatgtcaaataccgaaaaccgctgctcaaagccggcatcaaactctacgagctgcaacccaaccatgccgtccctgccacaaaagacaaaggcctgaccggcagctccgtaaccagcctgcatgccaaaaccttcattgtggacggcaaacgcatcttcatcggctcattcaacctcgacccccgttccgcacggctcaatactgaaatgggcgttgttatcgaaagccccaaaatcgcagaacagatggagcgcacccttgccgatacctcacccgaatacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaagtttattatag

SEQ ID NO: 41811 - protein, 508 aa, Neisseria meningitidis
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTSPEYAYRVTLDRHNRLQWHDPATRKTYPNEPEAKLWKRIAAKILSLLPIESLL

SEQ ID NO: 41812 - DNA, 2379 bp, Neisseria gonorrhoeae
atgaataaaaatattaaatctttaaatttacgggaaaaagacccgtttttaagtcgtgaaaaacagcgttatgaacatcctttgcccagtcgggaatggataatcgaattgttggagcgcaaaggtgtgccttcaaaaatcgaatcgcttgcacgcgagctgtcgattacggaagacgagtatgtcttttttgaacgccgtctgaaggcgatggcgcgggacggtcaggttttaatcaaccgccgaggcgcagtttgcgcggcggacaagctggatttggtcaaatgccgcgtcgaggcgcataaggacggtttcggcttcgccgtgccgctcatgccgatggacgaaggggatttcgttttatacgaacgccagatgcgtggtgtcatgcacggcgacaccgttaccgtccgtcctgcgggtatggaccgcaggggccgccgcgaagggacgtttctggatattgtcgaacgcgcgcaaagcaaagttgtcggccgtttctatatggataggggcgtggcgattttggagccggaagacaagcgtctgaaccaaagcatcgtgttggaaccggacggcgtggcgcgtttcaaacccgaatccggtcaggttatcgtcggcaaaattgaggtttatcccgagcaaaaccggcctgcagtggcaaaaatcattgaagttttgggcgattatgccgacagcgggatggaaatcgaaattgccgtgcgcaagcatcatttgccgcaccgattcagtgaagcgtgtgccaaatccgcgaaaaaaattcccgaccatgtacgcaaaagcgatttgaaaggccgcgtcgatttgtgcgaccttcctttggtaacgatagacggcgaaacggcgcgcgatttcgacgacgcggtgtttgccgaaaaagtcggacgcaattaccgcctggtcgtggcgattgcggatgtcagccattatgtccgccctgacgatgcgattgatgcagatgctcaagaacgcagtaccagcgtgtatttcccgcgccgtatgattccgatgctgccggaaaacctgtccaacggcatctgctcgctcaatcccgatgtcgagcgtttgtgtatggtgtgcgatatggtcgttacctatgcgggcaatatcaaagaataccgcttctatcccgccgtgatgcgctctcatgcccgcctgacctacaaccaagtttggaaatggctttcagacggcatcgggaatccgcacaaagcccaaatcgacacgctttacaagctgtttaaaattttgcagaaaaaacgtctggcgcgcggggcggtggagtttgaaagcgtcgaaacccagatgattttcgacgacaacggcaaaatcgaaaaaattgtccccgtcgtccgcaacgatgcccacaagctgattgaagaatgtatgctggcggcgaatgtttgcgcggcggattttctgttgaaaaacaaacatacggctttgttccgcaaccatttgggccccacgcccgaaaaactcgccaccctgcgcgagcagctcggtctgttggggcttcaacttggcggcggcgacaacccgtcgccgaaagactatgccgcgcttgccgaacaattcaaaggcaggccggatgccgaattgctgcaagtcatgatgttgcgctccatgcagcaggcggtttacgaaccgcattgcgaagggcatttcggtttggcttatgaagcatacgcccactttacctcgcccatccgccgctatcccgacctgaccgtccaccgtgccatcaaagccgtattgaaccggaaaacctacacgccaaacaaaagctggcaggctttgggcgtgcatacttcgttttgcgaacgccgtgccgacgatgctggccgcgatgtggaaaactggctgaaaacttattatatgcgcgataaggtcggtgaaatatttgaaggcaaaatctcccggggtgtggcaaattttggaatatttgtcactttggacgatatccatatcgacggtctggtacatatcagcgatttgggcgaagattatttcaacttccgccccgaaatcatggcaatcgaaggcgaacgcagcggcatccgtttcaatatgggggacagggttgccgtccgggtcgcgcgtgccgatttggatgatggaaaaatcgactttgtcctaattgccggagaaagcggcaggcggcggaaggtcaaattatccgcatctgccaaaccggcaggggcggcggggaaagggaaatcgaaaaccaccgccgagaaaaaaacagcccgatgcggcaaagtaaggggaaggggcgtgcctgccgttgccgaatcggggaaaaaggcaaagaaaccggttccgattaaggtcaaaaaacggaaaggcaaatcataa

SEQ ID NO: 41813 - protein, 792 aa, Neisseria gonorrhoeae
MNKNIKSLNLREKDPFLSREKQRYEHPLPSREWIIELLERKGVPSKIESLARELSITEDEYVFFERRLKAMARDGQVLINRRGAVCAADKLDLVKCRVEAHKDGFGFAVPLMPMDEGDFVLYERQMRGVMHGDTVTVRPAGMDRRGRREGTFLDIVERAQSKVVGRFYMDRGVAILEPEDKRLNQSIVLEPDGVARFKPESGQVIVGKIEVYPEQNRPAVAKIIEVLGDYADSGMEIEIAVRKHHLPHRFSEACAKSAKKIPDHVRKSDLKGRVDLCDLPLVTIDGETARDFDDAVFAEKVGRNYRLVVAIADVSHYVRPDDAIDADAQERSTSVYFPRRMIPMLPENLSNGICSLNPDVERLCMVCDMVVTYAGNIKEYRFYPAVMRSHARLTYNQVWKWLSDGIGNPHKAQIDTLYKLFKILQKKRLARGAVEFESVETQMIFDDNGKIEKIVPVVRNDAHKLIEECMLAANVCAADFLLKNKHTALFRNHLGPTPEKLATLREQLGLLGLQLGGGDNPSPKDYAALAEQFKGRPDAELLQVMMLRSMQQAVYEPHCEGHFGLAYEAYAHFTSPIRRYPDLTVHRAIKAVLNRKTYTPNKSWQALGVHTSFCERRADDAGRDVENWLKTYYMRDKVGEIFEGKISRGVANFGIFVTLDDIHIDGLVHISDLGEDYFNFRPEIMAIEGERSGIRFNMGDRVAVRVARADLDDGKIDFVLIAGESGRRRKVKLSASAKPAGAAGKGKSKTTAEKKTARCGKVRGRGVPAVAESGKKAKKPVPIKVKKRKGKS

SEQ ID NO: 41814 - DNA, 1926 bp, Neisseria meningitidis
acagttctggatattgtcgaacgcgcgcaaagcaaagtggtcggccgtttctatatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagctgcgaaaaaaattcccgtccatgtacgcaaaagcgatttgaaaggccgcgtcgatttgcgcgacctgcctttggtaacgatagacggcgaaacggcgcgcgatttcgacgacgcggtgtttgccgaaaaagtcggacgcaattaccgtctggtcgtggcgattgcggatgtcagccattatgtccgccctgacgatgtgattgatgcagatgctcaagaacgcagtaccagcgtatatttcccgcgccgtgtgattccgatgctgccggaaaacctgtctaacggcatttgctcgctcaatcccgatgtcgagcgtttgtgtatggtgtgcgatatggtcgttacctatgcgggcaatatcaaagaataccgcttctaccccgccgtaatgcgctctcatgcccgcctgacctacaaccaagtttggaaatggatttcagacggcatcgaccatccgtacaaagcccaaatcgacaccctttacaaactcttcaaaatccttcagaaaaagcgtttcgaacgcggcgcggtggagtttgaaagcgtcgaaacccagatgattttcgatgacaacggcaaaatcgaaaaaatcgtccccgttgtccgcaacgatgcccacaagctgattgaagaatgtatgctggcggcgaatgtttgcgcagcggatttcctgttgaaaaacaagcatacggctttgttccgcaaccatttgggccccacgcccgaaaaactcgccaccctgcgcgagcagctcggtctgttggggcttcaacttggcggcggcgacaacccgtcgccgaaagactatgccgcgcttgtcgaacaattcaaaggcagacctgatgccgaattgctgcaagtcatgatgttgcgctccatgcagcaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataa

SEQ ID NO: 41815 - protein, 641 aa, Neisseria meningitidis
TVLDIVERAQSKVVGRFYMDRGVAILEPEDKRLNQSIVLEPDGVARFKPESGQVIVGEIEVYPEQNRPAVAKIIEVLGDYADSGMEIEIAVRKHHLPHQFSEACAKAAKKIPVHVRKSDLKGRVDLRDLPLVTIDGETARDFDDAVFAEKVGRNYRLVVAIADVSHYVRPDDVIDADAQERSTSVYFPRRVIPMLPENLSNGICSLNPDVERLCMVCDMVVTYAGNIKEYRFYPAVMRSHARLTYNQVWKWISDGIDHPYKAQIDTLYKLFKILQKKRFERGAVEFESVETQMIFDDNGKIEKIVPVVRNDAHKLIEECMLAANVCAADFLLKNKHTALFRNHLGPTPEKLATLREQLGLLGLQLGGGDNPSPKDYAALVEQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 41816 - DNA, 2376 bp, Neisseria meningitidis
  misc_feature (504)..(504): n is a, c, g, or t
atgaataaaaatattaaatctttaaatttacgggaaaaagacccgtttttaagtcgtgaaaaacagcgttatgaacatcctttgcccagtcgggaatggataatcgagctgcttgaacgtaaaggcgtaccatccaagattgaagctttggtacgcgaattgtcgattaaggaagaagagtacgaatttttcgaacgtcgtctgaaggcgatggcgcgggacggtcaggttttaatcaaccgtcggggcgcggtttgcgcggcggacaaattggatttggtcaaatgccgtgtcaaggcgcacaaagaccgcttcggtttcgccgtgccgctcacgcccgccaaagacggtgattttgtcttgtacgaacgccagatgcgcggcattatgcacggcgatattgtcactgttcgtcctgccggcatggacggtaggggccgccgcgaagggacggttctggatattgtcgaacgcgcgcaaagcaaagtggtcggccgtttctanatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagccgcgaaaaaaattcccgaccatgtacgcaaaagcgatttgaaaggccgcgtcgatttgcgcgacctgcctttggtaacgatagacggcgaaacggctcgagattttgacgatgcggtgtttgccgagaaaatcggacgcaattaccgtctggtcgtggcgattgccgatgtcagccattatgtccgccccgatgacgctatcgacacggacgctcaggaacgcagcaccagtgtttacttcccgcgccgcgtgattcccatgttgccggaaaacctgtccaacggcatctgctcgctcaatcctcatgtcgagcgtttgtgtgtggtgtgcgatatggttatcacttacgcgggcaatatcaaagaataccgcttctaccccgccgtgatgcgctctcatgcccgcctgacctacaaccaagtttggaaatggctttcaggcggcatcgagcatccgttcaaaacccaaatcgacacgctttacaaactcttcaaaatccttcagaaaaagcgtttcgaacgcggggcggtggagtttgacagcatcgaaacccaaatgcttttcgacgacaacggtaaaattgaaaaaatcgtccccgttgtccgcaacgatgcccacaagctgattgaagaatgtatgttggcggcaaacgtttgcgcagcggattttctgttgaaaaacaagcataccgcattgttccgcaaccatttggggcccacgcccgaaaaactcgccgccttgcgcgagcagctcggtctgttggggcttcaacttggcggcggcgacaacccgtcgccgaaagactatgccgcgcttgccggacagttcaaaggcaggccggatgccgaattgctgcaagtcatgatgttgcgctccatgcaacaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataa

SEQ ID NO: 41817 - protein, 791 aa, Neisseria meningitidis
  misc_feature (168)..(168): Xaa can be any naturally occurring amino acid
MNKNIKSLNLREKDPFLSREKQRYEHPLPSREWIIELLERKGVPSKIEALVRELSIKEEEYEFFERRLKAMARDGQVLINRRGAVCAADKLDLVKCRVKAHKDRFGFAVPLTPAKDGDFVLYERQMRGIMHGDIVTVRPAGMDGRGRREGTVLDIVERAQSKVVGRFXMDRGVAILEPEDKRLNQSIVLEPDGVARFKPESGQVIVGEIEVYPEQNRPAVAKIIEVLGDYADSGMEIEIAVRKHHLPHQFSEACAKAAKKIPDHVRKSDLKGRVDLRDLPLVTIDGETARDFDDAVFAEKIGRNYRLVVAIADVSHYVRPDDAIDTDAQERSTSVYFPRRVIPMLPENLSNGICSLNPHVERLCVVCDMVITYAGNIKEYRFYPAVMRSHARLTYNQVWKWLSGGIEHPFKTQIDTLYKLFKILQKKRFERGAVEFDSIETQMLFDDNGKIEKIVPVVRNDAHKLIEECMLAANVCAADFLLKNKHTALFRNHLGPTPEKLAALREQLGLLGLQLGGGDNPSPKDYAALAGQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 41818 - DNA, 1383 bp, Neisseria gonorrhoeae
atgacccctttcacactgaaaaaaaccgtcctgctgctcggcactgcctttgccgccgcatctgtccacgcatccggctaccacttcggcacacagtcggtcaacgcgcaaagcacggcaaatgccgccgacgcgtcgaccatcttctacaatcccgccggcctgaccaaactcgacagcagccagatttccgtcaacgccaacatcgtgctgcccagcattcattatgaagcagattccgccaccgactttaccgggcttcccgtccaaggttctaaaaacggcaaaatcaccaaaaccacggtcgcaccccacatttacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacataattccgccgaactgcgcaaatatgccgactgaggaatcccaaaaaaagcgcaaatgctgcaagcaacaccttctaatcctactgccgctgctcaaatcaaggccgacggacacgccgatgtcaaaggcagcgattggggcgtcggctaccaactggcgtggatgtgggacatcaacgaccgcgcgcgcgtgggcgtgaactaccgttccaaagtttcacacacgctcaaaggcgatgccgaatgggcggcagacggcgcggcggcgaaacaacagtggaatgacaatatgctcacaccgctcggttacacggcgaatgaaaaagccagtgtcaaaatcgtaacgcctgagtctttgtccgtacacggcatgtacaaagtgtccgacaaagccgacctgttcggcgacgtaacttggacgcgccacagccgcttcaataaggcggaactgttttttgaaaaagaaaaaaatattgctaatggcaaaaaatccgaccgcaccaccatcacccccaactggcgcaacacctacaaagtcggcttgggcggttcttatcaaatcagcgaaccgctgcaactgcgcgtcggcatcgcttttgacaaaccgcctgtccgcaacgccgactaccgcatgaacagcctgcccgacggcaaccgcatctggttctccgccggcatgaaataccatatcggcaaaaaccacgtcgtcgatgccgcctacacccacatccacatcaacgacaccagctaccgcacggcgaaggcaagcggcaacgatgtggacagcaaaggtgcgtcttgcgcacgtttcaaaaaccacgccgacatcatcggcctgcaatacacctacaaattcaaataa

SEQ ID NO: 41819 - protein, 459 aa, Neisseria gonorrhoeae
MTPFTLKKTVLLLGTAFAAASVHASGYHFGTQSVNAQSTANAADASTIFYNPAGLTKLDSSQISVNANIVLPSIHYEADSATDFTGLPVQGSKNGKITKTTVAPHIYGAYKVNDNLTVGLGVYVPFGSATEYEKDSVLRHNINKLGLTSIAVEPVAAWKLNERHSFGAGIIAQHNSAELRKYADGIPKKAQMLQATPSNPTAAAQIKADGHADVKGSDWGVGYQLAWMWDINDRARVGVNYRSKVSHTLKGDAEWAADGAAAKQQWNDNMLTPLGYTANEKASVKIVTPESLSVHGMYKVSDKADLFGDVTWTRHSRFNKAELFFEKEKNIANGKKSDRTTITPNWRNTYKVGLGGSYQISEPLQLRVGIAFDKPPVRNADYRMNSLPDGNRIWFSAGMKYHIGKNHVVDAAYTHIHINDTSYRTAKASGNDVDSKGASCARFKNHADIIGLQYTYKFK

SEQ ID NO: 41820 - DNA, 1401 bp, Neisseria meningitidis
atgaccccttccgcactgaaaaaaaccgtcctgctgctcggcactgcctttgccgccgcatccgtccacgcatccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaccgccattccttcggcgcaggcatcatcgcccaacatacttccgccgaactgcgcaaatatgccgactgggggattaagagtaaagcagagatattgacggcaaaaccgcccaaacctaacggtgtagccgaagctgcaaaaattcaggccgacggacacgccgatgtcaaaggcagcgattggggcttcggctaccaactggcgtggatgtgggacatcaacgaccgtgcgcgcgtgggcgtgaactaccgttccaaagtctcgcacacgctcaaaggcgatgccgaatgggcggcagacggcgcggcggcgaaagcaatgtggagtacgatgcttgcagcaaacggctacacggcgaatgaaaaagcccgcgttaaaatcgttacgcctgagtctttgtccgtacacggtatgtacaaagtgtccgataaagccgacctgttcggcgacgtaacttggacgcgccacagccgcttcgataaggcggaactggtttttgaaaaagaaaaaaccgtcgtcaaaggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctacccgacggcaaccgcatctggttctccgccggtatgaaataccatatcggtaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggtctgcaatacacctacaaattcaaataa

SEQ ID NO: 41821 - protein, 466 aa, Neisseria meningitidis
MTPSALKKTVLLLGTAFAAASVHASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 41822 - DNA, 1395 bp, Neisseria meningitidis
atgaccccttccgcactgaaaaaaaccgtcctactgctcggcactgcctttgccgccgcatccgcacaagcctccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtaggcttgggcgtgtacgtccccttcggttctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacatacttccgccgagctgcgcaaatatgccgactgggggattatggaaaaagcgaaagcactaaaagaaacaccccccaatccaactaaagccgcccaaatcaaagccgacggacacgccgatgtcaaaggcagcgattggggcttcggctaccaactggcgtggatgtgggacatcaacgaccgtgcgcgcgtgggcgtgaactaccgttccaaagtctcacacacgctcaaaggcgatgccgaatgggcggcagacgacgcaatggcgaaacagttatgggatgcaaacaaactcgcactgctcggctacacgccaagcgaaaaagcccgcgttaaaatcgttacgcccgagtctttgtccgtacacggtatgtacaaagtgtccgacaaagccgacctgttcggcgacgtaacttggacgcgccacagccgcttcgataaggcggaactggtttttgaaaaagaaaaaaccatcgtcaacggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctgcccgacggcaaccgcatctggttctccgccggcatgaaataccatatcggcaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggcctgcaatacacctacaaattcaaataa

SEQ ID NO: 41823 - protein, 464 aa, Neisseria meningitidis
MTPSALKKTVLLLGTAFAAASAQASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADDAMAKQLWDANKLALLGYTPSEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 41824 - DNA, 1860 bp, Neisseria meningitidis
atgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttga

SEQ ID NO: 41825 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITEKYGADLKQAVKSQLQDLYKTRPEAWAENKKRTEEAYIAQFGTKFSTLKQTMPDLINKLVEDSVLTPHSNTSQTSLNNIFNKKLHVKIENKSHVAGQVLELTKMTLKDSLWEPRRHSDIHTLETSDNARIRLNTKDEKLTVHKDYAGGADFLFGYDVRESDEPALTFEDKVSGQSGVVLERRPENLKTLDGRKLIAAKTADSGSFAFKQNYRQGLYELLLKQCEGGFCLGVQRLAIPEAEAVLYAQQAYAANTLFGLRAADRGDDVYAADPSRQKLWLRFIGGRSHQNIRGGAAADGWRKGVQIGGEVFVRQNEGSRLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 41826 - DNA, 1860 bp, Neisseria meningitidis
atgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaactacaatagcggcatactcgccgtcgataatatgcccgttgttaagaaatatattacagatacttacggggataatttaaaggatgcggttaagaagcaattacaggatttatacaaaacaagacccgaagcttgggaagaaaataaaaaacggactgaggaggcgtatatagaacagcttggaccaaaatttagtatactcaaacagaaaaaccccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatatgctggaaacttccgataatgcccgcatccgcctgaacacgaaagatgaaaaactgaccgtccataaagcgtatcagggcggtgcggatttcctgttcggctacgacgtgcgggagtcggacaaacccgccctgacctttgaagaaaaagtcagcggacaatccggcgtggttttggaacgccggccggaaaatctgaaaacgctcgacgggcgcaaactgattgcggcggaaaaggcagactctaattcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgttcgggctgcgtgccgccgacaggggcgacgacgtgtatgccgccgatccgtcccgtcaaaaattgtggctgcgcttcatcggcggccggtcgcatcaaaatatacggggcggcgcggctgcggacgggcggcgcaaaggcgtgcaaatcggcggcgaggtgtttgtacggcaaaatgaaggcagccggctggcaatcggcgtgatgggcggcagggctggccagcacgcatcagtcaacggcaaaggcggtgcggcaggcagttatttgcatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcgttgtcggaaaaggcaataatgtgcggttttacctgcaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcgctcgaagggcggttcggcattgaagccggttggaaaggccatatgtccgcacgcatcggatacggcaaaaggacggacggcgacaaagaagccgcattgtcgctcaaatggctgttttga

SEQ ID NO: 41827 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHMLETSDNARIRLNTKDEKLTVHKAYQGGADFLFGYDVRESDKPALTFEEKVSGQSGVVLERRPENLKTLDGRKLIAAEKADSNSFAFKQNYRQGLYELLLKQCEGGFCLGVQRLAIPEAEAVLYAQQAYAANTLFGLRAADRGDDVYAADPSRQKLWLRFIGGRSHQNIRGGAAADGRRKGVQIGGEVFVRQNEGSRLAIGVMGGRAGQHASVNGKGGAAGSYLHGYGGGVYAAWHQLRDKQTGAYLDGWLQYQRFKHRINDENRAERYKTKGWTASVEGGYNALVAEGVVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 41828 - DNA, 702 bp, Neisseria gonorrhoeae
atgttcagacggcatcggcatttgaaaaatatgcagattaaaaaaatcatgaaatggcttcccgtcgccctgtcgcttttgggcgcgttgggttatacgggatatgacagtgaggcggtgcggacggcggttgccgtactcgacgtactcggcactgcaggggacgtgggtttcgacgcgcccgttcgccgacgggcatcggcgaaatccggccacagctacacaggcacggtgtccaaagtctatgacggcgatacccttcacgtcatcgacggcgacggcgcgaaacataaaattcggatggcgtatatcgacgcaccggagatgaaacaggcttacggtacacgttcgcgcgacaacctgcgcgcggcggcggagggtaggaaagtcagtgtacgtgtgtttgaaaccgaccgctatcagcgcgaagtggcgcaggtatccgccggcaaaaccgatttgaacctgatgcaggtgcaggacggggcggcgtggcattataaaagttatgctaaagaacagcaggataaggcggattttgccgactatgccgacgctcaaattcaggcggaaagggaacgcaaaggattgtggaaagctaaaaatccgcaagcgccgtgggcgtaccgccgggcaggcaggagcggcgggggcaataaggattggatggattccgtgggcgaatggttgggcatttggtaa

SEQ ID NO: 41829 - protein, 233 aa, Neisseria gonorrhoeae
MFRRHRHLKNMQIKKIMKWLPVALSLLGALGYTGYDSEAVRTAVAVLDVLGTAGDVGFDAPVRRRASAKSGHSYTGTVSKVYDGDTLHVIDGDGAKHKIRMAYIDAPEMKQAYGTRSRDNLRAAAEGRKVSVRVFETDRYQREVAQVSAGKTDLNLMQVQDGAAWHYKSYAKEQQDKADFADYADAQIQAERERKGLWKAKNPQAPWAYRRAGRSGGGNKDWMDSVGEWLGIW

SEQ ID NO: 41830 - DNA, 702 bp, Neisseria meningitidis
atgttcagacggcatcggcatttgaaaaatatgcagattaaaaaaatcatgaaatggcttcccgtcgccctgtcgcttttgggtgcgttgggttatacggggtacggcagcgaggcggtgcggacggcggttgccgtactcgacgtactcggcgcggcaggggacgcgggttccgacgcgcccgcccgccgccgagcatcggcgaaatccggccaccgctacacaggcacggtgtccaaagtctatgacggcgacacccttcacgttatcgacggcgacggcgcgaaacacaaaatccggatggcgtatatcgacgcgccggagatgaaacaggcttacggcacgcgttcgcgcgacaacctgcgcgcggcggcggaaggcaggaaagtcagcgtgcgcgtgttcgataccgaccgctaccagcgcgaagtggcgcaggtttctgtcggcaaaaccgatttgaacctgatgcaggtgcaggacggggcggcgtggcattataaaagttatgctaaagaacagcaggataaggcggattttgccgattatgccgacgctcaaattcaggcggaaagggaacgcaaaggattgtggaaagctaaaaatccgcaagcgccgtgggcgtaccgccgagcaggcaggagcggcgggggcaataaggattggatggatgccgtgggcgaatggttgggcatttggtaa

SEQ ID NO: 41831 - protein, 233 aa, Neisseria meningitidis
MFRRHRHLKNMQIKKIMKWLPVALSLLGALGYTGYGSEAVRTAVAVLDVLGAAGDAGSDAPARRRASAKSGHRYTGTVSKVYDGDTLHVIDGDGAKHKIRMAYIDAPEMKQAYGTRSRDNLRAAAEGRKVSVRVFDTDRYQREVAQVSVGKTDLNLMQVQDGAAWHYKSYAKEQQDKADFADYADAQIQAERERKGLWKAKNPQAPWAYRRAGRSGGGNKDWMDAVGEWLGIW

SEQ ID NO: 41832 - DNA, 700 bp, Neisseria meningitidis
atgttcagacggcatcggcatttgaaaaatatgcagattaaaaaaatcatgaaatggcttcccgtcgccttgtcgcttttgggtgcgttgggttatacggggtacggcagcgaggcggtgcggacggcggttgccgtactcgacgtactcggcgcggcaggggacgcgggttccgacgcgcccgcccgccgccgagcatcggcgaaatccggccaccgctacacaggcacggtgtccaaagtctatgacggcgacacccttcacgttatcgacggcgacggcgcgaaacacaaaatccggatggcgtatatcgacgcgccggagatgaaacaggcttacggcacgcgttcgcgcgacaacctgcgcgcggcggcggaaggcaggaaagtcagcgtccgcgtgttcgacaccgaccgctaccagcgcgaagtggcgcaggtttctgtcggcaaaaccgatttgaacctgatgcaggtgcaggacggggcggcgtggcattataaaagttatgctaaagaacagcaggataaggcggattttgccgattatgccgacgctcaaattcaggcggaaagggaacgcaaaggattgtggaaagctaaaaatccgcaagcgccgtgggcgtaccgccgggcaggcaggagcggcgggggcaataaggattggatggatgccgtgggcgaatggttgggcatttggt

SEQ ID NO: 41833 - protein, 233 aa, Neisseria meningitidis; identical to SEQ ID NO: 41831

SEQ ID NO: 41834 - DNA, 747 bp, Neisseria gonorrhoeae
ctgaaagtcgtattgggcagttttcaaggccctttggatctgctgctctaccttatccgcaagcagaacatcgatgttctcgatattccgatggtggaaattaccgggcagtatctgcactatattgcccaaatggaagcctatcagtttgatttggcggcggaatatcttttgatggcggcaatgctgattgaaatcaaatcgcgcctgctgctgccgcgtaccgaagccgtcgaagacgaagaggccgacccgcgtgccgagttggtgcgccgtctgcttgcctacgagcaaatgaaactggcggcgcagggtttggacgcgctgccgcgtgcgggacgggatttcgcgtgggcttacctgccgctggaaattgcagccgagacgaagctgcccgaggtttacatcgccgatttgatgcaggcatggttgggcattctttctcgggcaaaacatacgcgcagccacgaagtaatccaagaaaccctttccgtgcgcgcgcaaatgacggcaatcctgcgccgtttgaacgaacacgggatatgcaggtttcacgccctgttcaatcccgaacagggcgcggcttacgtgatcgtcaacttcatcgccctgttggagcttgccaaagaaggattggtcggaatcgtacaggaagacggtttcggagaaatccgaatcagcctcaatcatgagggggcgcattcagacggcattttcggcacacggggcgggcgcgatgtgttctaa

SEQ ID NO: 41835 - protein, 248 aa, Neisseria gonorrhoeae
LKVVLGSFQGPLDLLLYLIRKQNIDVLDIPMVEITGQYLHYIAQMEAYQFDLAAEYLLMAAMLIEIKSRLLLPRTEAVEDEEADPRAELVRRLLAYEQMKLAAQGLDALPRAGRDFAWAYLPLEIAAETKLPEVYIADLMQAWLGILSRAKHTRSHEVIQETLSVRAQMTAILRRLNEHGICRFHALFNPEQGAAYVIVNFIALLELAKEGLVGIVQEDGFGEIRISLNHEGAHSDGIFGTRGGRDVF

SEQ ID NO: 41836 - DNA, 747 bp, Neisseria meningitidis
ttgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaa

SEQ ID NO: 41837 - protein, 248 aa, Neisseria meningitidis
LKVVLGSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLGILSRAKHTRSHEVIKETISVRAQMTAILRRLNGHGICRFHDLFNPKQGAAYVVVNFIALLELAKEGLVRIVQEDGFGEIRISLNHEGAHSDGISGTRGGRDVF

SEQ ID NO: 41838 - DNA, 747 bp, Neisseria meningitidis
ctgaaagtcgtattgagcagttttcaaggccctttggatctgctgctctaccttatccgcaagcagaacatcgatgttctcgatattccgatggtgaagattaccgaacagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgagcagatgaagctggcggcacaagggttggatgcgcttcctcgtgcgggccgggatttcgcatgggcatacctgccactggaaattgccgtcgaagccaagctgcccgaagtctatattaccgacttgacgcaggcgtggctgagtattttgtctcgggcaaaacatacgcgcagccacgaagttatcaaagaaaccatctccgtgcgcgcgcaaatgacggcaatcctgcgccgtttgaacaaacacgggatatgcaggtttcacgacctgttcaatcccgaacagggcgcggcttacgtggtcgtcaacttcatcgcactgttggagcttgccaaagaaggtttggtcggaatcgtacaggaagtcggtttcggagaaatccgaatcagcctcaatcatgagggggcgcattcagacggcatttccggcacacggggcgggcgcgatgtgttctaa

SEQ ID NO: 41839 - protein, 248 aa, Neisseria meningitidis
LKVVLSSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLSILSRAKHTRSHEVIKETISVRAQMTAILRRLNKHGICRFHDLFNPEQGAAYVVVNFIALLELAKEGLVGIVQEVGFGEIRISLNHEGAHSDGISGTRGGRDVF

SEQ ID NO: 41840 - DNA, 624 bp, Neisseria gonorrhoeae
atgaacagaagaaccttcctcctcggcgcaggcgcgttgcttcttaccgcctgcggcagaaaatccgcccgaacccacgccaaaattcccgaaggaagcaccgtgcttgccttgggcgattcgctcaccttcggctacggagcaaaccccggcgaatcctaccccgcgcaactgcaaaaactgacgggttggaatattgtcaacggcggcgtatcgggcgatacgtccgcgcaagccctatcgcgcctgcccgcgctgttggcacgcaaacccaagcttgtgattgtcggcataggcggcaacgactttctgcgcaaagttcccgaggagcagacccgcgccaatatcgcgaaaatcatcgaaaccgtgcaaaaggaaaacattcccgccgtcctcgtcggcgtgccgcacatcacactgggcgcgttgttcgggcatttgagcgaccatccgctgtatgaggatttgtccgaggaatacggcattccgttgttcggcggcgcgtgggcggaaattttgggcaataataatctgaaatccgaccaaatccacgccaacggcaaaggctatcggaaattcgccgaaaatttgaatcaatttttgagaaaacatgggtttagataa

SEQ ID NO: 41841 - protein, 200 aa, Neisseria gonorrhoeae
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPEEQTRANIAKIIETVQKENIPAVLVGVPHITLGALFGHLSDHPLYEDLSEEYGIPLFGGAWAEILGNNNLKSDQIHANGKGYRKFAENLNQF

SEQ ID NO: 41842 - DNA, 624 bp, Neisseria meningitidis
atgaacagaagaaccttcctcctcggcgcaggcgcgttgctgcttaccgcctgcggcagaaaatccgcccgaacccacgccaaaattcccgaaggaagcaccgtacttgccttgggcgattcgcttaccttcggctacggcgcaaaccctggcgaatcctaccccgcgcaactgcaaaaactgacgggttggaatattgtcaacggcggcgtatcgggcgatacatctgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacatcacactgggtgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataa

SEQ ID NO: 41843 - protein, 207 aa, Neisseria meningitidis
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPKEQTRANIAKIIETVQKENIPAVLVGVPHITLGALFGHLSDHPLYEDLSEEYGIPLFGGAWAEILGDNNLKSDQIHANGKGYRKFAEDLNQFLRKQGFR

SEQ ID NO: 41844 - DNA, 624 bp, Neisseria meningitidis
atgaacagaagaaccttcctcctcggcgcaggcgcgttgctccttaccgcctgcggcagaaaatccgcccgaacccacgccaaaattcccgaaggaagcaccgtacttgccttgggcgattcgcttaccttcggctacggcgcaaaccccggcgaatcctaccccgcgcaactgcaaaaactgacgggttggaatattgtcaacggcggcgtatcgggcgatacatccgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacattaccttgggcgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataa

SEQ ID NO: 41845 - protein, 207 aa, Neisseria meningitidis; identical to SEQ ID NO: 41843

SEQ ID NO: 41846 - DNA, 1053 bp, Neisseria gonorrhoeae
atgatgaacacgccgcatccgcgcccgaaaatcgccgtcatcggcgcaggctgggccggcttgtccgccgccgtcaccttggcgcggcacgccgacgttaccctgtttgaagccggccggcaggcgggcggaagggcgcgcacactggccggaaataccgacggtttcggttttttggacaacgggcagcacattttgctcggcgcataccggggcgtgttgcgcctgatgaaaaccatcggttcagacccccgtgccgcctttttgcgcgtaccgctgcactggcatatgcacggcggtttgcagttccgcgccctccccctgcccgcgccgctgcatattttgggcggcgtgctgcttgcccggcgcgtaccgtccgcattcaaagccaaactgcttgccgatatgtccgatttgcagaagtccgcacgcctcggacagcccgacacgacagttgcacaatggctgaaacagcggaacgtgccgcgtgccgccgtaatgcagttttggcagcccttggtctggggcgcgctcaacacgcctttggaaaccgcaagcctgcgcgtgttgtgcaacgttttgtccgacggcgtgctgacgaaaaaatccggcagcgactatctcctacccaaacaggatttgggcgcaatcgtcgccgaacccgccttggcggagcttcaacggctcggcgcggacatccgcctcgaaacgcgcgtatgccgtctgaacaccctcccggacggaaaagtcctcgtcaacggcgaagccttcgatgccgccatacttgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggcattgccgacggcacggcacaatggctgctttgcccggggcaggctccggactgcccccaaaacgaagtctccgccgtcattagcgtttccgaccgcgtcggcgcgtttgcaaaccga

SEQ ID NO: 41847 - protein, 351 aa, Neisseria gonorrhoeae
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRVCRLNTLPDGKVLVNGEAFDAAILATAPYHAAALLPEGTPEHVQTAYQNLRYHAITTVYLRYAEPVRLPAPLTGIADGTAQWLLCPGQAPDCPQNEVSAVISVSDRVGAFANR

SEQ ID NO: 41848 - DNA, 1314 bp, Neisseria meningitidis
atgatgaacacgccgcatccgcgcccgaaaatcgccgtcatcggcgcaggctgggcaggactgtccgccgccgtcaccttggcgcggcacgccgacgttaccctgtttgaagccggccggcaggcgggcggcagggcgcgcacactggccggaaataccgacggtttcggttttttggacaacgggcagcacattttgctcggcgcataccggggcgtgttgcgcctgatgaaaaccatcggttcggatccccgtgccgcctttttgcgcgtaccgctgcactggcatatgcacggcggtttgcagttccgcgccctccccctgcccgcgccgctgcatattttgggcggcgtgctgcttgcccggcgtgcaccgactgcattcaaagccaaactgcttgccgatatgtccgatttgcagaagtccgcacgcctcggacagcccgacacgacagtggcgcaatggctgaaacagcggaacgtgccgcgtgccgccgtgatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaagcaggatttgggcgcaatcgtcgccgaacccgccttggcggatcttcaacggctcggcgcggacatccgcctcgaaacgcgcgtatgccgtctgaacaccctcccggacgggaaagtgctcgtcaacggcgaagctttcgatgccgccgtccccgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggccttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagcccacgccgacctcaaacgcatccttccgcatttgggcgaacccgaagccgtgcgcgtcatcaccgaaaaacgcgccacaaccgcagccgatgccccgccgccggacttgtcgtggttgcaccggcaccgcatcttccccgccggcgactacctccacccggactaccccgccacgctcgaagccgccgtacaatcaggtttcgcgtcggcggaagcctgcctgcaaagcctgagcgatgccgtctga

SEQ ID NO: 41849 - protein, 437 aa, Neisseria meningitidis
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRAPTAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALADLQRLGADIRLETRVCRLNTLPDGKVLVNGEAFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKAHADLKRILPHLGEPEAVRVITEKRATTAADAPPPDLSWLHRHRIFPAGDYLHPDYPATLEAAVQSGFASAEACLQSLSDAV

SEQ ID NO: 41850 - DNA, 1314 bp, Neisseria meningitidis
atgatgaacacgccgcatccgcgcccgaaaatcgccgtcatcggcgcaggctgggccggcttgtccgccgccgttaccttggcgcggcacgccgacgttaccctgtttgaagccggccggcaggcgggcggcagggcgcgcgcactggccggaaataccgacggtttcggttttttggacaacgggcagcatattttactcggcgcataccggggcgtgttgcgcctgatgaaaaccatcggttcagacccccatgccgcctttttgcgcgtaccgctgcactggcatatgcacggcggtttgcagttccgcgccctccccctgcccgcgcccctgcatattttgggcggcgtgctgcttgcccggcgcgtaccgtccgcattcaaagccaaactgcttgccgatatgtccgatttgcagaagtccgcacgcctcggacagcccgacacgacagtggcgcaatggctgaaacagcggaacgtgccgcgtgccgccgtaatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaaacaggatttgggcgcaatcgtcgccgaacccgccttggcggagcttcaacggctcggcgcggacatccgcctcgaaacgcgcatatgccgtctgaacaccctcccggacgggaaagtgctcgtcaacggcgaacctttcgatgccgccgtccccgccaccgcgccctaccacgccgccgcgctcctgcccgaaggcacgcccgaacacgttcagacggcatatcaaaaccttcgctatcacgccatcaccaccgtctatctgcgctatgccgaacccgtccgcttgcctgccccgctgaccggacttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagttcacgccgacctcaaacgcatccttccgcatttgggcgaacccgaagccgtgcgcgtcatcaccgaaaaacgcgccacaaccgcagccgatgccccgccgccggatttgtcgtggttgcaccggcaccgcatcttccccgccggcgactacctccacccagactaccccgccacgctcgaagccgccgtacaatcaggtttcgcgtcggcggaagcctgcctgcaaagcctgagcgatgccgtctga

SEQ ID NO: 41851 - protein, 437 aa, Neisseria meningitidis
MMNTPHPRPKIAVIGAGWAGLSAAVTLARHADVTLFEAGRQAGGRARALAGNTDGFGFLDNGQHILLGAYRGVLRLMKTIGSDPHAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRICRLNTLPDGKVLVNGEPFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKVHADLKRILPHLGEPEAVRVITEKRATTAADAPPPDLSWLHRHRIFPAGDYLHPDYPATLEAAVQSGFASAEACLQSLSDAV

SEQ ID NO: 41852 - DNA, 603 bp, Neisseria meningitidis
atgaatatgaaaaaattgatttccgcaatttgtgtttcaattgttttatcagcctgcaaccaacaatcaaaaacggcacaagccgaagaacctgtccaaagtatccaggctgctgattgtaccgccccaatggacatcacagttgaacaatatctcatcaatttggagcaagcatttaaaactcagaacgtctcaacaaaaatccataataaaaatattgtcaagaccgattgtggttatgaccttactttggtaatggattttggggcgattgcgctcaaactggacgagcagcaaaaaattagagctatctcagtaggctacattttaaaaaccgacggagagaaaggacaaaatctagtcaataatgccataaatggattacacagtattcaggcagttctgtctttaactaccacagacaaattgggcgaatcggaagcaggaaaacaactttttacagctttaaccgaagtcgtcaaagaatccaatcagacaggagcaacagcgcaaaaagacgttccggcagatggtattttatatagcgttgtttttgaaaaagaaacaaacaccattgcaataatcggcagaaaacaaccctaa

SEQ ID NO: 41853 - protein, 200 aa, Neisseria meningitidis
MNMKKLISAICVSIVLSACNQQSKTAQAEEPVQSIQAADCTAPMDITVEQYLINLEQAFKTQNVSTKIHNKNIVKTDCGYDLTLVMDFGAIALKLDEQQKIRAISVGYILKTDGEKGQNLVNNAINGLHSIQAVLSLTTTDKLGESEAGKQLFTALTEVVKESNQTGATAQKDVPADGILYSVVFEKETNTIAIIGRKQP

SEQ ID NO: 41854 - DNA, 1194 bp, Neisseria gonorrhoeae; identical to SEQ ID NO: 39820

SEQ ID NO: 41855 - DNA, 33 bp, Artificial Sequence; identical to SEQ ID NO: 38815
  Description of Artificial Sequence: Primers

SEQ ID NO: 41856 - protein, 28 aa, Artificial Sequence
  Description of Artificial Sequence: Primers
CCCGCTCGAGTTTAGAAGCGGGCGGCAA

SEQ ID NO: 41857 - DNA, 34 bp, Artificial Sequence; identical to SEQ ID NO: 38817
  Description of Artificial Sequence: Primers

SEQ ID NO: 41858 - protein, 27 aa, Artificial Sequence
  Description of Artificial Sequence: Primers
CCCGCTCGAGTTTGGCGGTTTTGCTGC

SEQ ID NO: 41859 - DNA, 30 bp, Artificial Sequence; identical to SEQ ID NO: 38819
  Description of Artificial Sequence: Primers

SEQ ID NO: 41860 - protein, 31 aa, Artificial Sequence; identical to SEQ ID NO: 38820
  Description of Artificial Sequence: Primers

SEQ ID NO: 41861 - DNA, 33 bp, Artificial Sequence; identical to SEQ ID NO: 38821
  Description of Artificial Sequence: Primers

SEQ ID NO: 41862 - protein, 25 aa, Artificial Sequence
  Description of Artificial Sequence: Primers
CCCGCTCGAGCGGGCGGTATTCGGG

SEQ ID NO: 41863 - DNA, 32 bp, Artificial Sequence; identical to SEQ ID NO: 38823
  Description of Artificial Sequence: Primers

SEQ ID NO: 41864 - protein, 29 aa, Artificial Sequence
  Description of Artificial Sequence: Primers
CCCGCTCGAGATAATAATATCCCGCGCCC

SEQ ID NO: 41865 - DNA, 29 bp, Artificial Sequence
  Description of Artificial Sequence: Primers
cgcggatcccatatgactgacaacgcact

SEQ ID NO: 41866 - protein, 26 aa, Artificial Sequence
  Description of Artificial Sequence: Primers
CCCGCTCGAGGACCGCGTTGTCGAAA

SEQ ID NO: 41867 - DNA, 31 bp, Artificial Sequence; identical to SEQ ID NO: 38827
  Description of Artificial Sequence: Primers

SEQ ID NO: 41868 - protein, 31 aa, Artificial Sequence; identical to SEQ ID NO: 38828
  Description of Artificial Sequence: Primers

SEQ ID NO: 41869 - DNA, 32 bp, Artificial Sequence; identical to SEQ ID NO: 38829
  Description of Artificial Sequence: Primers

SEQ ID NO: 41870 - protein, 28 aa, Artificial Sequence
  Description of Artificial Sequence: Primers
CCCGCTCGAGATCCTGCTCTTTTTTGCC

SEQ ID NO: 41871 - DNA, 31 bp, Artificial Sequence; identical to SEQ ID NO: 38831
  Description of Artificial Sequence: Primers

SEQ ID NO: 41872 - protein, 28 aa, Artificial Sequence
  Description of Artificial Sequence: Primers
CCCGCTCGAGAGGTTGTCCTTGTCTATG

SEQ ID NO: 41873 - DNA, 459 bp, Neisseria meningitidis; identical to SEQ ID NO: 38727

SEQ ID NO: 41874 - protein, 152 aa, Neisseria meningitidis; identical to SEQ ID NO: 38728

SEQ ID NO: 41875 - DNA, 459 bp, Neisseria gonorrhoeae; identical to SEQ ID NO: 38729

SEQ ID NO: 41876 - protein, 152 aa, Neisseria meningitidis; identical to SEQ ID NO: 38730

SEQ ID NO: 41877 - DNA, 459 bp, Neisseria meningitidis; identical to SEQ ID NO: 38731
  misc_feature (6)..(6): n is a, c, g, or t
  misc_feature (8)..(8): n is a, c, g, or t
  misc_feature (38)..(39): n is a, c, g, or t
  misc_feature (96)..(96): n is a, c, g, or t
  misc_feature (102)..(102): n is a, c, g, or t
  misc_feature (341)..(341): n is a, c, g, or t
  misc_feature (390)..(390): n is a, c, g, or t
  misc_feature (410)..(410): n is a, c, g, or t

SEQ ID NO: 41878 - protein, 152 aa, Neisseria meningitidis; identical to SEQ ID NO: 38732
  misc_feature (3)..(3): Xaa can be any naturally occurring amino acid
  misc_feature (13)..(13): Xaa can be any naturally occurring amino acid
  misc_feature (114)..(114): Xaa can be any naturally occurring amino acid
  misc_feature (137)..(137): Xaa can be any naturally occurring amino acid

SEQ ID NO: 41879 - DNA, 600 bp, Neisseria meningitidis; identical to SEQ ID NO: 38733

SEQ ID NO: 41880 - protein, 199 aa, Neisseria meningitidis; identical to SEQ ID NO: 38734

SEQ ID NO: 41881 - DNA, 951 bp, Neisseria gonorrhoeae; identical to SEQ ID NO: 38735

SEQ ID NO: 41882 - protein, 316 aa, Neisseria gonorrhoeae; identical to SEQ ID NO: 38736

SEQ ID NO: 41883 - DNA, 948 bp, Neisseria meningitidis; identical to SEQ ID NO: 38737

SEQ ID NO: 41884 - protein, 315 aa, Neisseria meningitidis; identical to SEQ ID NO: 38738

SEQ ID NO: 41885 - DNA, 948 bp, Neisseria meningitidis; identical to SEQ ID NO: 38739

SEQ ID NO: 41886 - protein, 315 aa, Neisseria meningitidis; identical to SEQ ID NO: 38740

SEQ ID NO: 41887 - DNA, 948 bp, Neisseria gonorrhoeae; identical to SEQ ID NO: 38741

SEQ ID NO: 41888 - protein, 315 aa, Neisseria gonorrhoeae; identical to SEQ ID NO: 38742

SEQ ID NO: 41889 - DNA, 948 bp, Neisseria meningitidis; identical to SEQ ID NO: 38737

SEQ ID NO: 41890 - protein, 315 aa, Neisseria meningitidis; identical to SEQ ID NO: 38738

SEQ ID NO: 41891 - DNA, 669 bp, Neisseria meningitidis; identical to SEQ ID NO: 38745

SEQ ID NO: 41892 - protein, 222 aa, Neisseria meningitidis; identical to SEQ ID NO: 38746

SEQ ID NO: 41893 - DNA, 648 bp, Neisseria gonorrhoeae; identical to SEQ ID NO: 38747

SEQ ID NO: 41894 - protein, 215 aa, Neisseria gonorrhoeae; identical to SEQ ID NO: 38748

SEQ ID NO: 41895 - DNA, 819 bp, Neisseria meningitidis; identical to SEQ ID NO: 38749

SEQ ID NO: 41896 - protein, 272 aa, Neisseria meningitidis; identical to SEQ ID NO: 38750

SEQ ID NO: 41897 - DNA, 819 bp, Neisseria meningitidis; identical to SEQ ID NO: 38751

SEQ ID NO: 41898 - protein, 272 aa, Neisseria meningitidis; identical to SEQ ID NO: 38752

SEQ ID NO: 41899 - DNA, 819 bp, Neisseria gonorrhoeae; identical to SEQ ID NO: 38753

SEQ ID NO: 41900 - protein, 272 aa, Neisseria gonorrhoeae; identical to SEQ ID NO: 38754

SEQ ID NO: 41901 - DNA, 819 bp, Neisseria meningitidis; identical to SEQ ID NO: 38749

SEQ ID NO: 41902 - protein, 272 aa, Neisseria meningitidis; identical to SEQ ID NO: 38750

SEQ ID NO: 41903 - DNA, 1326 bp, Neisseria meningitidis; identical to SEQ ID NO: 38757

SEQ ID NO: 41904 - protein, 441 aa, Neisseria meningitidis; identical to SEQ ID NO: 38758

SEQ ID NO: 41905 - DNA, 1326 bp, Neisseria gonorrhoeae; identical to SEQ ID NO: 38761

SEQ ID NO: 41906 - protein, 441 aa, Neisseria gonorrhoeae; identical to SEQ ID NO: 38762

SEQ ID NO: 41907 - DNA, 1326 bp, Neisseria meningitidis; identical to SEQ ID NO: 38763

SEQ ID NO: 41908 - protein, 441 aa, Neisseria meningitidis; identical to SEQ ID NO: 38764

SEQ ID NO: 41909 - DNA, 858 bp, Neisseria meningitidis
  misc_feature (752)..(752): n is a, c, g, or t
  misc_feature (839)..(839): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgcagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 41910 - protein, 366 aa, Neisseria meningitidis; identical to SEQ ID NO: 38766
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid

SEQ ID NO: 41911 - DNA, 1101 bp, Neisseria gonorrhoeae; identical to SEQ ID NO: 38767

SEQ ID NO: 41912 - protein, 366 aa, Neisseria gonorrhoeae; identical to SEQ ID NO: 38768

SEQ ID NO: 41913 - DNA, 1101 bp, Neisseria meningitidis; identical to SEQ ID NO: 38769

SEQ ID NO: 41914 - protein, 366 aa, Neisseria meningitidis; identical to SEQ ID NO: 38770

SEQ ID NO: 41915 - DNA, 1101 bp, Neisseria meningitidis; identical to SEQ ID NO: 38771
  misc_feature (995)..(995): n is a, c, g, or t
  misc_feature (1082)..(1082): n is a, c, g, or t

SEQ ID NO: 41916 - protein, 366 aa, Neisseria meningitidis; identical to SEQ ID NO: 38772
  misc_feature (332)..(332): Xaa can be any naturally occurring amino acid
  misc_feature (361)..(361): Xaa can be any naturally occurring amino acid

SEQ ID NO: 41917 - DNA, 1101 bp, Neisseria meningitidis; identical to SEQ ID NO: 38769

SEQ ID NO: 41918 - protein, 366 aa, Neisseria meningitidis; identical to SEQ ID NO: 38770

SEQ ID NO: 41919 - DNA, 1431 bp, Neisseria meningitidis; identical to SEQ ID NO: 39316
  misc_feature (1216)..(1216): n is a, c, g, or t
  misc_feature (1334)..(1334): n is a, c, g, or t
  misc_feature (1347)..(1347): n is a, c, g, or t

SEQ ID NO: 41920 - protein, 426 aa, Neisseria meningitidis
  misc_feature (99)..(99): Xaa can be any naturally occurring amino acid
  misc_feature (108)..(108): Xaa can be any naturally occurring amino acid
  misc_feature (117)..(117): Xaa can be any naturally occurring amino acid
  misc_feature (140)..(140): Xaa can be any naturally occurring amino acid
  misc_feature (148)..(148): Xaa can be any naturally occurring amino acid
  misc_feature (239)..(239): Xaa can be any naturally occurring amino acid
  misc_feature (263)..(263): Xaa can be any naturally occurring amino acid
  misc_feature (278)..(278): Xaa can be any naturally occurring amino acid
  misc_feature (281)..(281): Xaa can be any naturally occurring amino acid
  misc_feature (289)..(289): Xaa can be any naturally occurring amino acid
  misc_feature (293)..(293): Xaa can be any naturally occurring amino acid
  misc_feature (297)..(297): Xaa can be any naturally occurring amino acid
  misc_feature (356)..(356): Xaa can be any naturally occurring amino acid
  misc_feature (395)..(395): Xaa can be any naturally occurring amino acid
NTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 41921 - DNA, 2037 bp, Neisseria gonorrhoeae; identical to SEQ ID NO: 38777

SEQ ID NO: 41922 - protein, 678 aa, Neisseria gonorrhoeae; identical to SEQ ID NO: 38778

SEQ ID NO: 41923 - DNA, 2037 bp, Neisseria meningitidis; identical to SEQ ID NO: 38779

SEQ ID NO: 41924 - protein, 678 aa, Neisseria meningitidis; identical to SEQ ID NO: 38780

SEQ ID NO: 41925 - DNA, 2037 bp, Neisseria meningitidis; identical to SEQ ID NO: 38781

SEQ ID NO: 41926 - protein, 678 aa, Neisseria meningitidis; identical to SEQ ID NO: 38782

SEQ ID NO: 41927 - DNA, 1473 bp, Neisseria gonorrhoeae; identical to SEQ ID NO: 38783

SEQ ID NO: 41928 - protein, 491 aa, Neisseria gonorrhoeae; identical to SEQ ID NO: 38784

SEQ ID NO: 41929 - DNA, 2037 bp, Neisseria meningitidis; identical to SEQ ID NO: 38779

SEQ ID NO: 41930 - protein, 678 aa, Neisseria meningitidis; identical to SEQ ID NO: 38780

SEQ ID NO: 41931 - DNA, 534 bp, Neisseria meningitidis; identical to SEQ ID NO: 38787

SEQ ID NO: 41932 - protein, 177 aa, Neisseria meningitidis; identical to SEQ ID NO: 38788
  misc_feature (116)..(116): Xaa can be any naturally occurring amino acid

SEQ ID NO: 41933 - DNA, 534 bp, Neisseria gonorrhoeae; identical to SEQ ID NO: 38789

SEQ ID NO: 41934 - protein, 177 aa, Neisseria gonorrhoeae; identical to SEQ ID NO: 38790

SEQ ID NO: 41935 - DNA, 534 bp, Neisseria meningitidis; identical to SEQ ID NO: 38791

SEQ ID NO: 41936 - protein, 177 aa, Neisseria meningitidis; identical to SEQ ID NO: 38792

SEQ ID NO: 41937 - DNA, 1467 bp, Neisseria meningitidis; identical to SEQ ID NO: 38793

SEQ ID NO: 41938 - protein, 488 aa, Neisseria meningitidis; identical to SEQ ID NO: 38794

SEQ ID NO: 41939 - DNA, 1290 bp, Neisseria gonorrhoeae; identical to SEQ ID NO: 38795

SEQ ID NO: 41940 - protein, 429 aa, Neisseria gonorrhoeae; identical to SEQ ID NO: 38796

SEQ ID NO: 41941 - DNA, 1494 bp, Neisseria meningitidis; identical to SEQ ID NO: 38797

SEQ ID NO: 41942 - protein, 497 aa, Neisseria meningitidis; identical to SEQ ID NO: 38798

SEQ ID NO: 41943 - DNA, 963 bp, Neisseria meningitidis; identical to SEQ ID NO: 38799

SEQ ID NO: 41944 - protein, 320 aa, Neisseria meningitidis; identical to SEQ ID NO: 38800

SEQ ID NO: 41945 - DNA, 963 bp, Neisseria gonorrhoeae; identical to SEQ ID NO: 38801

SEQ ID NO: 41946 - protein, 320 aa, Neisseria gonorrhoeae; identical to SEQ ID NO: 38802

SEQ ID NO: 41947 - DNA, 963 bp, Neisseria meningitidis; identical to SEQ ID NO: 38803

SEQ ID NO: 41948 - protein, 320 aa, Neisseria meningitidis; identical to SEQ ID NO: 38804

SEQ ID NO: 41949 - protein, 222 aa, Neisseria meningitidis
MDSFFKPAVWAVLWLMFAVRPALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRFLN

SEQ ID NO: 41950 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41951 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41952 - protein, 251 aa, Neisseria meningitidis; identical to SEQ ID NO: 39635

SEQ ID NO: 41953 - protein, 251 aa, Neisseria meningitidis
MDSFFKPAVWAVLWLMFAVRLALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41954 - protein, 251 aa, Neisseria meningitidis; identical to SEQ ID NO: 39635

SEQ ID NO: 41955 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGSAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41956 - protein, 251 aa, Neisseria meningitidis; identical to SEQ ID NO: 39635

SEQ ID NO: 41957 - protein, 251 aa, Neisseria meningitidis; identical to SEQ ID NO: 39635

SEQ ID NO: 41958 - protein, 251 aa, Neisseria meningitidis; identical to SEQ ID NO: 41955

SEQ ID NO: 41959 - protein, 251 aa, Neisseria meningitidis; identical to SEQ ID NO: 41951

SEQ ID NO: 41960 - protein, 251 aa, Neisseria meningitidis; identical to SEQ ID NO: 39635

SEQ ID NO: 41961 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41962 - protein, 251 aa, Neisseria meningitidis; identical to SEQ ID NO: 41951

SEQ ID NO: 41963 - protein, 251 aa, Neisseria meningitidis
MDSFFKPAVWAVLWLMFAVRPALADELTNLLSSREQILRQFAEDEQPVLPVNRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFIQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41964 - protein, 251 aa, Neisseria meningitidis; identical to SEQ ID NO: 39635

SEQ ID NO: 41965 - protein, 222 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41966 - protein, 251 aa, Neisseria meningitidis; identical to SEQ ID NO: 39635

SEQ ID NO: 41967 - protein, 251 aa, Neisseria meningitidis; identical to SEQ ID NO: 39635

SEQ ID NO: 41968 - protein, 251 aa, Neisseria meningitidis; identical to SEQ ID NO: 39635

SEQ ID NO: 41969 - protein, 251 aa, Neisseria meningitidis; identical to SEQ ID NO: 39635

SEQ ID NO: 41970 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 41971 - protein, 251 aa, Neisseria meningitidis; identical to SEQ ID NO: 39635

SEQ ID NO: 41972 - protein, 251 aa, Neisseria meningitidis; identical to SEQ ID NO: 41951

SEQ ID NO: 41973 - protein, 251 aa, Neisseria meningitidis; identical to SEQ ID NO: 41951

SEQ ID NO: 41974 - protein, 251 aa, Neisseria meningitidis; identical to SEQ ID NO: 41951

SEQ ID NO: 41975 - protein, 251 aa, Neisseria meningitidis; identical to SEQ ID NO: 41951

SEQ ID NO: 41976 - protein, 251 aa, Neisseria meningitidis; identical to SEQ ID NO: 41951

SEQ ID NO: 41977 - protein, 251 aa, Neisseria meningitidis; identical to SEQ ID NO: 39635

SEQ ID NO: 41978 - protein, 251 aa, Neisseria meningitidis; identical to SEQ ID NO: 39635

SEQ ID NO: 41979 - protein, 251 aa, Neisseria meningitidis; identical to SEQ ID NO: 39635

SEQ ID NO: 41980 - protein, 222 aa, Neisseria meningitidis; identical to SEQ ID NO: 41949

SEQ ID NO: 41981 - protein, 222 aa, Neisseria meningitidis
MDSFFKPAVWAVLWLMFAVRSALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRIKKNDPSRFLN

SEQ ID NO: 41982 - protein, 251 aa, Neisseria meningitidis; identical to SEQ ID NO: 41951

SEQ ID NO: 41983 - protein, 215 aa, Neisseria meningitidis; identical to SEQ ID NO: 39703

SEQ ID NO: 41984 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVSAVVNQIANNLTDRGYQVSKTAAYNLLSPYSHNGILKGPRFVEEQPK

SEQ ID NO: 41985 - protein, 215 aa, Neisseria meningitidis; identical to SEQ ID NO: 39705

SEQ ID NO: 41986 - protein, 215 aa, Neisseria meningitidis; identical to SEQ ID NO: 39705

SEQ ID NO: 41987 - protein, 215 aa, Neisseria meningitidis; identical to SEQ ID NO: 39705

SEQ ID NO: 41988 - protein, 215 aa, Neisseria meningitidis; identical to SEQ ID NO: 41984

SEQ ID NO: 41989 - protein, 215 aa, Neisseria meningitidis; identical to SEQ ID NO: 39705

SEQ ID NO: 41990 - protein, 215 aa, Neisseria meningitidis; identical to SEQ ID NO: 41984

SEQ ID NO: 41991 - protein, 215 aa, Neisseria meningitidis
MKPLILGLAAALVLSACQVQKAPDFDYTSFKESKPASILVVPPLNESPDVNGTWGMLASTAEPLSEAGYYVFPAAVVEETFKQNGLTNAADIHAVQPEKLHQIFGNDAVLYITITEYGTSYQILDSVTTVSARARLVDSRNGKVLWSGSASIREGSNNSNSGLLGALVSAVVNQIANSLTDRGYQVSKTAAYNLLSPYSHNGILKGPRFVEEQPK

SEQ ID NO: 41992 - protein, 215 aa, Neisseria meningitidis; identical to SEQ ID NO: 39705

SEQ ID NO: 41993 - protein, 215 aa, Neisseria meningitidis; identical to SEQ ID NO: 39705

SEQ ID NO: 41994 - protein, 215 aa, Neisseria meningitidis; identical to SEQ ID NO: 39705

SEQ ID NO: 41995 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 41996 - protein, 215 aa, Neisseria meningitidis; identical to SEQ ID NO: 39705

SEQ ID NO: 41997 - protein, 215 aa, Neisseria meningitidis; identical to SEQ ID NO: 39705

SEQ ID NO: 41998 - protein, 215 aa, Neisseria meningitidis; identical to SEQ ID NO: 39705

SEQ ID NO: 41999 - protein, 215 aa, Neisseria meningitidis; identical to SEQ ID NO: 41995

SEQ ID NO: 42000 - protein, 215 aa, Neisseria meningitidis; identical to SEQ ID NO: 39705

SEQ ID NO: 42001 - protein, 215 aa, Neisseria meningitidis; identical to SEQ ID NO: 39705

SEQ ID NO: 42002 - protein, 215 aa, Neisseria meningitidis; identical to SEQ ID NO: 39705

SEQ ID NO: 42003 - protein, 215 aa, Neisseria meningitidis; identical to SEQ ID NO: 39705

SEQ ID NO: 42004 - protein, 215 aa, Neisseria meningitidis; identical to SEQ ID NO: 39705

SEQ ID NO: 42005 - protein, 215 aa, Neisseria meningitidis
MKPLILGLAAVLALSACQVQKAPDFDYTSFKESKPASILVVPPLNESPDVNGTWGMLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 42006 - protein, 215 aa, Neisseria meningitidis; identical to SEQ ID NO: 39705

SEQ ID NO: 42007 - protein, 215 aa, Neisseria meningitidis; identical to SEQ ID NO: 39705

SEQ ID NO: 42008 - protein, 215 aa, Neisseria meningitidis; identical to SEQ ID NO: 39705

SEQ ID NO: 42009 - protein, 215 aa, Neisseria meningitidis
MKPLILGLAAVLALSACQVQKAPDFDYTAFKESKPASILVVPPLNESPDVNGTWGMLASTAEPLSEAGYYVFPAAVVEETFKQNGLTNAADIHAVRPEKLHQIFGNDAVLYITITEYGTSYQILDSVTTVSARARLVDSRNGKVLWSGSASIREGSNNSNSGLLGALVGAVVNQIANSLTDRGYQVSKAAAYDLLSPYSHNGILKGPRFVEEQPK

SEQ ID NO: 42010 - protein, 215 aa, Neisseria meningitidis; identical to SEQ ID NO: 39703

SEQ ID NO: 42011 - protein, 215 aa, Neisseria meningitidis; identical to SEQ ID NO: 39703

SEQ ID NO: 42012 - protein, 215 aa, Neisseria meningitidis; identical to SEQ ID NO: 39705

SEQ ID NO: 42013 - protein, 492 aa, Neisseria meningitidis
MFKRSVIAMACIFALSACGGGGGGSPDVKSADTLSKPAAPVVSEKETEAKEDAPQAGSQGQGAPSAQGGQDMAAVSEENTGNGGAAATDKPKNEDEGAQNDMPQNAADTDSLTPNHTPASNMPAGNMENQAPDAGESEQPANQPDMANTADGMQGDDPSAGGENAGNTAAQGTNQAENNQTAGSQNPASSTNPSATNSGGDFGRTNVGNSVVIDGPSQNITLTHCKGDSCSGNNFLDEEVQLKSEFEKLSDADKISNYKKDGKNDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPSKGEMLAGTAVYNGEVLHFHTENGRPSPSRGRFAAKVDFGSKSVDGIIDSGDGLHMGTQKFKAAIDGNGFKGTWTENGGGDVSGKFYGPAGEEVAGKYSYRPTDAEKGGFGVFAGKKEQD

SEQ ID NO: 42014 - protein, 492 aa, Neisseria meningitidis; identical to SEQ ID NO: 42013

SEQ ID NO: 42015 - protein, 488 aa, Neisseria meningitidis; identical to SEQ ID NO: 38794

SEQ ID NO: 42016 - protein, 497 aa, Neisseria meningitidis; identical to SEQ ID NO: 38798

SEQ ID NO: 42017 - protein, 429 aa, Neisseria meningitidis; identical to SEQ ID NO: 38796

SEQ ID NO: 42018 - protein, 488 aa, Neisseria meningitidis; identical to SEQ ID NO: 38794

SEQ ID NO: 42019 - protein, 315 aa, Neisseria meningitidis; identical to SEQ ID NO: 38742

SEQ ID NO: 42020 - protein, 315 aa, Neisseria meningitidis; identical to SEQ ID NO: 38738

SEQ ID NO: 42021 - protein, 315 aa, Neisseria meningitidis; identical to SEQ ID NO: 38740

SEQ ID NO: 42022 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 42023 - protein, 315 aa, Neisseria meningitidis; identical to SEQ ID NO: 42022

SEQ ID NO: 42024 - protein, 315 aa, Neisseria meningitidis; identical to SEQ ID NO: 42022

SEQ ID NO: 42025 - protein, 315 aa, Neisseria meningitidis; identical to SEQ ID NO: 42022

SEQ ID NO: 42026 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVFSALDEAAGAWGVKVLRYEIKDLVPPQEILRSMQAQITAERKKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 42027 - protein, 315 aa, Neisseria meningitidis; identical to SEQ ID NO: 38740

SEQ ID NO: 42028 - protein, 315 aa, Neisseria meningitidis
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 42029 - protein, 315 aa, Neisseria meningitidis; identical to SEQ ID NO: 38740

SEQ ID NO: 42030 - protein, 315 aa, Neisseria meningitidis; identical to SEQ ID NO: 38740

SEQ ID NO: 42031 - protein, 315 aa, Neisseria meningitidis; identical to SEQ ID NO: 38740

SEQ ID NO: 42032 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSMISAGMKIIDSSKTAK

SEQ ID NO: 42033 - protein, 315 aa, Neisseria meningitidis; identical to SEQ ID NO: 38740

SEQ ID NO: 42034 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAKIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 42035 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 42036 - protein, 315 aa, Neisseria meningitidis; identical to SEQ ID NO: 38740

SEQ ID NO: 42037 - protein, 315 aa, Neisseria meningitidis; identical to SEQ ID NO: 42028

SEQ ID NO: 42038 - protein, 315 aa, Neisseria meningitidis
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSIVVSALDEAAGAWGVKVLRYEIKDLVPPQEILRSMQAQITAEREKRARIAESEGRKIEQINLASGQREPEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSNKTAK

SEQ ID NO: 42039 - protein, 315 aa, Neisseria meningitidis; identical to SEQ ID NO: 38742

SEQ ID NO: 42040 - protein, 315 aa, Neisseria meningitidis; identical to SEQ ID NO: 42028

SEQ ID NO: 42041 - protein, 441 aa, Neisseria meningitidis; identical to SEQ ID NO: 38762

SEQ ID NO: 42042 - protein, 441 aa, Neisseria meningitidis; identical to SEQ ID NO: 38764

SEQ ID NO: 42043 - protein, 441 aa, Neisseria meningitidis; identical to SEQ ID NO: 38758

SEQ ID NO: 42044 - protein, 441 aa, Neisseria meningitidis; identical to SEQ ID NO: 38758

SEQ ID NO: 42045 - protein, 441 aa, Neisseria meningitidis; identical to SEQ ID NO: 38758

SEQ ID NO: 42046 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42047 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLSCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42048 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42049 - protein, 441 aa, Neisseria meningitidis; identical to SEQ ID NO: 38758

SEQ ID NO: 42050 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42051 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42052 - protein, 441 aa, Neisseria meningitidis; identical to SEQ ID NO: 42051

SEQ ID NO: 42053 - protein, 441 aa, Neisseria meningitidis
MKKYLFRAALCGIAAAILAACQSKSIQTFPQPDTSVINGPDRPVGIPAPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42054 - protein, 441 aa, Neisseria meningitidis; identical to SEQ ID NO: 38758

SEQ ID NO: 42055 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAEQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42056 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSRNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42057 - protein, 441 aa, Neisseria meningitidis
MKKYLFRAALYGIAAAILAACQSKSIQTFPQPDTSVINGPDRPVGIPDLAGTTVGGGGAVYTVVPHLSLPHWAAQDFAKSLQSFRLGCANLKNHQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42058 - protein, 441 aa, Neisseria meningitidis
MKKYLFRAALCGIAAAILAACQSKSIQTFPQPDTSVINGPGRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42059 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42060 - protein, 441 aa, Neisseria meningitidis; identical to SEQ ID NO: 38758

SEQ ID NO: 42061 - protein, 441 aa, Neisseria meningitidis; identical to SEQ ID NO: 38758

SEQ ID NO: 42062 - protein, 441 aa, Neisseria meningitidis; identical to SEQ ID NO: 38758

SEQ ID NO: 42063 - protein, 441 aa, Neisseria meningitidis; identical to SEQ ID NO: 38758

SEQ ID NO: 42064 - protein, 441 aa, Neisseria meningitidis; identical to SEQ ID NO: 38764

SEQ ID NO: 42065 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTSKALNRLIMAQDTGSAIKGAVRVDYFWGYGDEAGETAGKMKEPGYVWQLLPNGMKPEYRP

SEQ ID NO: 42066 - protein, 441 aa, Neisseria meningitidis; identical to SEQ ID NO: 42051

SEQ ID NO: 42067 - protein, 441 aa, Neisseria meningitidis; identical to SEQ ID NO: 42051

SEQ ID NO: 42068 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42069 - protein, 441 aa, Neisseria meningitidis
MKKYLFRAALYGISAAILAACQSKSIQTFPQPDTSVINGPDRPAGIPDPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGETAGKMKEPGYVWQLLPNGMKPEYRP

SEQ ID NO: 42070 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42071 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSGNDGPVGALGTPLMGEYAGAVDRHYITLGAPLFVATTHPITRKALNRLIMAQDTGSAIKGAVRVDYFWGYGDEAGELAGKQKTTGYVWQLLPNGMKPEYRP

SEQ ID NO: 42072 - protein, 441 aa, Neisseria meningitidis
MKKHLFRAALYGIAAAILAACQSKSIQTFPQPDTSIIKGPDRPAGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYVFFRELAGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 42073 - protein, 441 aa, Neisseria meningitidis
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGGDGPVGALGTPLMGGYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 42074 - protein, 441 aa, Neisseria meningitidis
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPIHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPHKLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 42075 - protein, 441 aa, Neisseria meningitidis; identical to SEQ ID NO: 42050

SEQ ID NO: 42076 - protein, 215 aa, Neisseria meningitidis; identical to SEQ ID NO: 39705

SEQ ID NO: 42077 - DNA, 582 bp, Neisseria meningitidis
atgaaacacactgtatccgcatcggtcatcctgcttttgaccgcttgcgcgcaattacctcaaaataacgaaaacctgtggcagccgtccgaacacacccgcagtttcacggcggaagggcggttggcagtgaaagcggaagggaaaggttcgtatgcaaatttcgattggacataccaaccgcccgtggaaaccatcaatatcaacacccctttgggcagtacgctcgggcagttgtgtcaagacagggacggcgcattggcagtggacggcaaaggaaatgtctatcaggcggaaagtgcggaagaattgagcaggcagctggtcggtttcaaactgccaatccaatatctgcatatctgggcagatggcaggcctgtggcgggcgcgccttaccgcatcctgccggacggcatattggaacaatacggttggactgtcggcagaaccgccgacagtggggggcaagtccgaacgttgcaactgaataacggaaatttgaacatcaggctggttttcaccgagattggtatgccgtctgaaaccgaaacccaagaacaatgcgcggcacgcatacagtaa

SEQ ID NO: 42078 - protein, 351 aa, Neisseria meningitidis
VPPVQSAPVYTPPAYVPPSAPAVSGTYVPSYAPVDINAATHTIVRGDTVYNISKRYHISQDDFRAWNGMTDNTLSIGQIVKVKPAGYAAPKAAAVKSRPAVPAAAQPPVQSAPVDINAATHTIVRGDTVYNISKRYHISQDDFRAWNGMTDNMLSIGQIVKVKPAGYAAPKTAAVESRPAVPAAVQTPVKPAAQPPVQSAPQPAAPAAENKAVPAPAPQSPAASPSGTRSVGGIVWQRPTQGKVVADFGGNNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 42079 - DNA, 1248 bp, Neisseria meningitidis
  misc_feature (224)..(224): n is a, c, g, or t
  misc_feature (289)..(289): n is a, c, g, or t
atgttgacaccaacaacactttaggtagcttgtaccgcccttgccgctcagttgggcggatgccccacccaacacccttctcctgtcattgcaggcaattcaggtatgcagaccgtaccgtctgcgccggtttacaatccttatggcgcaacgccgtacaatgccgctcctgccgccaacgatgcgccgtatgtgccgccggtgcaaagcgcgccggtttatangcctcctgcttatgttccgccgtctgcacctgccgtttcgggtacatacgttccttcttacgcanccgtcgacatcaacgcggcgacccatactattgtgcgcggcgacaccgtgtacaagatttccaaatgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgctcgtacagtccgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgcaggaaatgcgggacagcccgttttggcggcggctgacggcaaagtggtttatgcaggttccggtttgaggggatacggcaatttggtcatcatccagcataattcttccttcctgaccgcatacgggcacaaccaaaaattgctggtcggcgaaggccagcaggtcaaacgcgggcagcaggtcgctttgatgggcaataccgaggcttctagaacgcagcttcatttcgaggtgcggcaaaacggcaaaccggttaatccgaacagctatatcgcgttctga

SEQ ID NO: 42080 - protein, 414 aa, Neisseria meningitidis
  misc_feature (74)..(74): Xaa can be any naturally occurring amino acid
  misc_feature (96)..(96): Xaa can be any naturally occurring amino acid
MLTPTTLVACTALAAQLGGCPTQHPSPVIAGNSGMQTVPSAPVYNPYGATPYNAAPAANDAPYVPPVQSAPVYXPPAYVPPSAPAVSGTYVPSYAXVDINAATHTIVRGDTVYKISKCYHISQDDFRAWNGMTDNTLSIGQIVKVKPAGYAAPKAAAVKSRPAVPAAAQPLVQSAPVDINAATHTIVRGDTVYNISKRYHISQDDFRAWNGMTDNTLSIGQIVKVKPAGYAAPKAAAVKSRPAVPAAVQTPVKPAAQPPVQSAPQPAAPAAENKAVPAPAPQSPAASPSGTRSVGGIVWQRPTQGKVVADFGGNNKGVDIAGNAGQPVLAAADGKVVYAGSGLRGYGNLVIIQHNSSFLTAYGHNQKLLVGEGQQVKRGQQVALMGNTEASRTQLHFEVRQNGKPVNPNSYIAF

SEQ ID NO: 42081 - DNA, 849 bp, Neisseria gonorrhoeae
  misc_feature (741)..(741): n is a, c, g, or t
atggtgtccctccgcttcagattcggcaaccactttaaacgccgacattctgacaatttccttttccgccagccaaatatcatgcgtatctttcggttcgggcttgttgggcatggcaaccttcaacagccgcgccatcacaggaatcgtcgttccctgaatcagcagcgacagcaccaccacggcaaacgccacatcaaacagcaggtgcgaattgggaacgcccatcaccagcggcatcatcgccagcgaaatcggtacggctcctcgcaagcccaaccaactgatatacgccttttcacgcaggctgtaattgaatttccacaaaccgccgaacactgccagcggacgcgcgaccagcatcaggaacgccgcaatcgccaaggcttccgccgccctgtccaacacgccggcgggagaaaccagcagaccgagcatgacgaacaaagttgcctgcgccagccaagccaaaccgtccatcacacgcaaaacgtgttccgtcgcacggttgcgctggttaccgacaatgatgccggcaaggtaaaccgccaaaaagccgctgccgcctatggtattggtaaacgcaaacacaagcagcccgcccgacacaatcatcagcgcgtacagaccttccgtacacacctccaattcccaatcaacgtcatagctgtctcccgtgttaaaatgttcttcacttcagaatcccccccttcttcccagcccgaaaccttcatgtgttanaccctggggtgccccaacggatttagtaacctcccaatgactctgcttgtcgcccccttcgcccgctttctccttccgggaaaacttgttgtccccgtcttacattaa

SEQ ID NO: 42082 - protein, 282 aa, Neisseria gonorrhoeae
  misc_feature (247)..(247): Xaa can be any naturally occurring amino acid
MVSLRFRFGNHFKRRHSDNFLFRQPNIMRIFRFGLVGHGNLQQPRHHRNRRSLNQQRQHHHGKRHIKQQVRIGNAHHQRHHRQRNRYGSSQAQPTDIRLFTQAVIEFPQTAEHCQRTRDQHQERRNRQGFRRPVQHAGGRNQQTEHDEQSCLRQPSQTVHHTQNVFRRTVALVTDNDAGKVNRQKAAAAYGIGKRKHKQPARHNHQRVQTFRTHLQFPINVIAVSRVKMFFTSESPPSSQPETFMCXTLGCPNGFSNLPMTLLVAPFARFLLPGKLVVPVLH

SEQ ID NO: 42083 - DNA, 252 bp, Neisseria meningitidis
cgcctgaagcacggtgtcggactgcatttctattcggctatacgccttttcacgcaggctgtaattgaatttccacaaaccgccgaacactgccgacggacgcgcgaccagcatcaggaacgccgcaatcgccaaggcttccgccgccctgtccaacacgttggcaggagaaaccagcagcaaaggcattcccaaacgtgcggacaaagtggtcgaaaccacgctcagaaacaacagtgcgccacccggcag

SEQ ID NO: 42084 - protein, 84 aa, Neisseria meningitidis
RLKHGVGLHFYSAIRLFTQAVIEFPQTAEHCRRTRDQHQERRNRQGFRRPVQHVGRRNQQQRHSQTCGQSGRNHAQKQQCATRQ

SEQ ID NO: 42085 - DNA, 213 bp, Neisseria meningitidis
atacgccttttcacgcaggctgtaattgaatttccacaaaccgccgaacactgccggcggacgcgcgaccagcatcaggaacgccgcaatcgccaaggcttccgccgccccgtccaacacgttggcaggagaaaccagcagcaaaggcattcccaaacgtgcggacaaagtggtcgaaaccacgctcagaaacaacagtgcgccacccggcag

SEQ ID NO: 42086 - protein, 71 aa, Neisseria meningitidis
IRLFTQAVIEFPQTAEHCRRTRDQHQERRNRQGFRRPVQHVGRRNQQQRHSQTCGQSGRNHAQKQQCATRQ

SEQ ID NO: 42087 - DNA, 771 bp, Neisseria gonorrhoeae
atgcggcgaaacgtgcctgccgtcgccgtattgcgccgcccacgattcgaggcgtttttggatttggcgttggctcaggcgcgtgccgttcctgccggtaaacagggctttgccgtccgatgccgtctgacgcagcggcagatagtttttcaaggcttccacgcttttgccggtcagcggaacctgacgctgcttgcgccctttgccggtaacgtgtacccacgcttcgtccaaatatacatcatctgcattcaagccgtgtatctcgctcacgcgcaaaccgctgccgtacatcagctcgaacagcgcgtggtcgcgcaccgccagcgggtcgccgccgtccacgggcaaatccaacatccggttcagccattcctgcggcagggctttgggtacgcgctcgggctgcttcggcggtttgatgtcggcggtcgggtcggcgcgcatcagcccgcgtttgaccagccaggcgcaatactgccgccacgccgacagcttgcgcgccagcgtccgaccgtccaaaccgcgctgcgacagccgccgcaacgccgccgtaaaatcgcgccgcgacaagtcctgcggcacgccgcctgcatcttcagacggcatttgtgccaacagtgcaaacagttcttccaaatcgcgccggtatgccgcaaccgtgtgctccgacttgccctcgcgcacgatgttttccaaataagcgtcaaaatacgccgcaaacccgtccaaaaccataaccgtcccacacaaatatcaaaaaaccagtga

SEQ ID NO: 42088 - protein, 256 aa, Neisseria gonorrhoeae
MRRNVPAVAVLRRPRFEAFLDLALAQARAVPAGKQGFAVRCRLTQRQIVFQGFHAFAGQRNLTLLAPFAGNVYPRFVQIYIICIQAVYLAHAQTAAVHQLEQRVVAHRQRVAAVHGQIQHPVQPFLRQGFGYALGLLRRFDVGGRVGAHQPAFDQPGAILPPRRQLARQRPTVQTALRQPPQRRRKIAPRQVLRHAACIFRRHLCQQCKQFFQIAPVCRNRVLRLALAHDVFQISVKIRRKPVQNHNRPTQISKNQ

SEQ ID NO: 42089 - DNA, 527 bp, Neisseria meningitidis
atgcggcgaaacgtgcmtgcmgtcgccgttktgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccgaccagcggcacctgccgctgttgcgccctttgccgataacgtgtacccacgcytcgtccaaatagacatcatctgcattcaagccgtgtatctcgctcacgcgcaaaccgctgccgtacatcagttcgaacagggcgtggtcgcgcaccgccagcgggtcgccgccgtccacgggcaaatccagcatccggttcagccattcctgcggcagggctttgggtacgcgctcgggctgcttcggcggtttgatgtcggcggtcgggtcggcgtgcatcaggccgcgctttaccagccaaacgcaatactgccgccaagacgaaagcttgcgagccagcgtccgttcccccaaaccgcg

SEQ ID NO: 42090 - protein, 176 aa, Neisseria meningitidis
  misc_feature (6)..(6): Xaa can be any naturally occurring amino acid
  misc_feature (11)..(11): Xaa can be any naturally occurring amino acid
  misc_feature (65)..(65): Xaa can be any naturally occurring amino acid
  misc_feature (76)..(76): Xaa can be any naturally occurring amino acid
MRRNVXAVAVXRRPLRQTFLDLALAQARAVPAGKQGFAVRCRLTQRQIVFQGFHAFADQRHLPLXAPFADNVYPRXVQIDIICIQAVYLAHAQTAAVHQFEQGVVAHRQRVAAVHGQIQHPVQPFLRQGFGYALGLLRRFDVGGRVGVHQAALYQPNAILPPRRKLASQRPFPQTA

SEQ ID NO: 42091 - DNA, 771 bp, Neisseria meningitidis
atgcggcgaaacgtgcctgccgtcgccgttttgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccggtcagcggaacctgccgctgcttgcgtcctttgccggtaacgtgtacccacgcctcgtccaaatatacatcatctgcattcaagccgtgtatctcgctcacgcgcaaaccgctgccgtacatcagttcgaacagcgcgtgatcgcgcaccgccagcgggtcgccgccgtccacgggcaaatccagcatccggttcagccattcctgcggcagggctttgggtacgcgctcgggctgcttcggcggtttgatgtcggcggtcgggtcggtatgcagcagaccgcgtttgaccagccaggcgcaatactgccgccaagacgacagcttgcgcgccagcgtccgcgcattcaaaccgcgctgcgacagccgccgcaacgccgccgtaaaatcgcgctgcgacaagccctgcggcacgccgcctgcatcttcagacggcatttgtgccaacagcgcaaacagttcttccaaatcgcgccggtatgccgccaccgtgtgctccgacttgccctcgcgcacgatgttttccaaataagcgtcaaaatgcgccgcaaacccgtccaaaaccataaccgccccacacaaatatcaaaaaaacagtga

SEQ ID NO: 42092 - protein, 256 aa, Neisseria meningitidis
MRRNVPAVAVLRRPLRQTFLDLALAQARAVPAGKQGFAVRCRLTQRQIVFQGFHAFAGQRNLPLLASFAGNVYPRLVQIYIICIQAVYLAHAQTAAVHQFEQRVIAHRQRVAAVHGQIQHPVQPFLRQGFGYALGLLRRFDVGGRVGMQQTAFDQPGAILPPRRQLARQRPRIQTALRQPPQRRRKIALRQALRHAACIFRRHLCQQRKQFFQIAPVCRHRVLRLALAHDVFQISVKMRRKPVQNHNRPTQISKKQ

SEQ ID NO: 42093 - DNA, 1530 bp, Neisseria gonorrhoeae
atggcggcggcggacaaactcttgggcggcgaccgccgcagcgtcgccatcatcggagacggcgcgatgacggcggggcaggcgtttgaagccttgaattgcgcgggcgatatggatgtggatttgctggtcgtcctcaacgacaacgaaatgtcgatttcccccaacgtcggcgcgttgcccaaatatcttgccagcaacgtcgtgcgcgatatgcacggactgttgagtaccgtcaaagcgcaaacgggcaaggtattagacaaaatacccggcgcgatggagtttgcccaaaaagtcgaacacaaaatcaaaacccttgccgaagaagccgaacacgccaaacagtcgctgtcgctgtttgaaaatttcggcttccgctacaccggccccgtggacggacacaacgtcgagaatctggtggacgtattgaaagacttgcgcagccgcaaaggccctcagttgctgcacgtcatcaccaaaaagggcaacggctacaaactcgccgaaaacgaccccgtcaaataccacgccgtcgccaacctgcctaaagaaggcggggcgcaaatgccgtctgaaaaagaacccaagcccgccgccaaaccgacctatacccaagtattcggcaaatggctgtgcgaccgggcggcggcagattcccgactggttgcgattacccccgccatgcgcgagggcagcggactggtggagtttgaacaacgattccccgaccgctatttcgatgtcggcatcgccgagcagcacgccgttacctttgccggcggtttggcgtgcgaaggcatgaagcccgtcgtggcgatttattccacctttttacaacgcgcctacgaccaactggtgcacgacatcgccctgcaaaacctgcccgttttgtttgccgtcgaccgtgcgggcatcgtcggcgcggacggtccgacccatgccggcttgtacgatttgagcttcttgcgctgtgtgccgaacatgattgttgccgcgccgagcgatgaaaacgaatgccgcctgctgctttcgacctgctatcaggcggatgcgcccgccgccgtccgctatccgcgcggcacgggtacgggcgcgccggtttcagacggcatggaaaccgtggaaatcggcaagggcattatccgccgcgaaggtgagaaaaccgccttcattgccttcggcagtatggtcgccaccgcattggcggttgccgaaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcggcgcggtcttggaagtgttggcgaaacacggcatctgcaaacccgttttgcttttgggcgttgccgataccgtaaccgaacacggcgatccgaaaaaacttttggacgatttgggtttgagtgccgaagcggtggaacgccgggtgcgcgagtggctgccggaccgtgatgcggcaaattaa

SEQ ID NO: 42094 - protein, 509 aa, Neisseria gonorrhoeae
MAAADKLLGGDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKEGGAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVATALAVAEKLNATVADMRFVKPIDEELIVRLARSHDRIVTLEENAEQGGAGGAVLEVLAKHGICKPVLLLGVADTVTEHGDPKKLLDDLGLSAEAVERRVREWLPDRDAAN

SEQ ID NO: 42095 - DNA, 1529 bp, Neisseria meningitidis
atggcggcggcagacaaactcttgggcagcgaccgccgcagcgtcgccatcatcggcgacggcgcgatgacggcggggcaggcgtttgaagccttgaattgcgcagcgatatggatgtrgatttgctrgtcgtcctcaacgacaacgaaatgtcgatttcccccaacgtcggcgcgctgccgaaataccttgccagcaacgtcgtgcgcgatatgcacggcctgttgagtaccgtcaaagcgcaaacgggcaaggtattagacaaaatacccggcgcgatggagtttgcccaaaaagtcgaacacaaaatcaaaacccttgccgaagaagccgaacacgccaaacagtcgctgtctttgtttgaaaacttcggcttccgctacaccggccccgtggacggacacaacgtcgaaaatctggtggacgtattgaaagacttgcgcagccgcaaaggccctcagttgctgcacgtcatcaccaaaaagggcaacggctacaaactcgccgaaaacgaccccgtcaaataccacgccgtcgccaacctgcctaaagaaagcgcggcgcaaatgccgtctgaaaaagaacccaagcccgccgccaaaccgacctatacccaagtgttcggcaaatggctgtgcgaccgggcggcggcagattcccgactggttgcgattacccccgccatgcgcgagggcagcggcttggttgagtttgaacaacgattccccgaccgctatttcgatgtcggcatcgccgagcagcacgccgttacctttgccggcggtttggcttgcgaagggatgaagcccgtcgtggcgatttattccacctttttacaacgcgcctacgaccaactggtgcacgacatcgccctgcaaaacctacccgttttgtttgccgtcgaccgcgcgggcatcgtcggcgcggacggcccgacccatgccggtctgtacgatttgagctttttgcgctgcgtgccgaacatgattgtcgccgcgccgagcgatgaaaacgaatgccgcctgttgctttcgacctgctatcaggcagacgcgcccgccgccgtccgctatccgcgcggcacgggtacgggcgcgccggtttcagacggcatggaaaccgtggaaatcggcaagggcattatccgccgcgaaggtgagaaaaccgcattcattgccttcggcagtatggtcgcccccgcattggcggttgccgaaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcggcgcggtgctggaagtattggcgaaacacggcatctgcaaacccgttttgcttttgggcgttgccgataccgtaaccggacacggcgatccgaaaaaacttttagacgatttgggcttgagtgccgaagcggtggaacggcgtgtgcgcgcgtggctgtcggatcgggatgcggcaaattaa

SEQ ID NO: 42096 - protein, 509 aa, Neisseria meningitidis
  misc_feature (36)..(36): Xaa can be any naturally occurring amino acid
MAAADKLLGSDRRSVAIIGDGAMTAGQAFEALNCAXDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVAPALAVAEKLNATVADMRFVKPIDEELIVRLARSHDRIVTLEENAEQGGAGGAVLEVLAKHGICKPVLLLGVADTVTGHGDPKKLLDDLGLSAEAVERRVRAWLSDRDAAN

SEQ ID NO: 42097 - DNA, 1530 bp, Neisseria meningitidis
atggcggcggcggacaaacagttgggcagcgaccgccgcagcgtcgccatcatcggcgacggcgcgatgacggcgggtcaggcgtttgaagccttgaactgcgcgggcgatatggatgtggatttgctggtcgtcctcaacgacaacgaaatgtcgatttcccccaacgtcggtgcgttgcccaaataccttgccagcaacgtcgtgcgcgatatgcacggactgttgagtaccgtcaaagcgcaaacgggcaaggtattagacaaaatacccggcgcgatggagtttgcccaaaaagtcgaacataaaatcaaaacccttgccgaagaagccgaacacgccaaacagtcactgtctttgtttgaaaacttcggcttccgctataccggccccgtggacggacacaacgtcgaaaatctggtcgatgtattggaagacctgcgcggacgcaaaggcccgcagcttctgcacgtcatcaccaaaaagggcaacggctacaaactcgccgaaaacgatcccgtcaaataccacgccgtcgccaacctgcctaaagaaagcgcggcgcaaatgccgtctgaaaaagaacccaagcccgccgccaaaccgacctatacccaagtgttcggcaaatggctgtgcgaccgggcggcggcagattcccgactggttgcgattacccccgccatgcgcgagggcagcggcttggttgagtttgaacaacgattccccgaccgctatttcgatgtcggcatcgccgagcagcacgccgttacctttgccggcggtttggcttgcgaagggatgaagcccgtcgtggcgatttattccacctttttacaacgcgcctacgaccaactggtgcacgacatcgccctgcaaaacctgcccgttttgtttgccgtcgaccgcgcgggcatcgtcggcgcggacggcccgacccatgccggtttgtacgatttaagctttttgcgctgcattccgaatatgattgtcgccgcgccgagcgatgaaaatgaatgccgcctgctgctttcgacctgctatcaggcagacgcgcccgccgccgtccgctatccgcgcggcacgggtacgggcgtgccggtttcagacggcatggaaaccgtggaaatcggcaagggcattatccgccgcgaaggtgagaaaaccgcattcattgccttcggcagtatggtcgcccctgcattggcggtcgccggaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcagcgcggtgctggaagtgttggcgaaacacggcatctgcaaacccgtcttgcttttgggcgttgccgataccgtaaccggacacggcgatccgaaaaaacttttagacgatttgggcttgagtgccgaagcggtggaacggcgtgtgcgcgcgtggctgtcggatcgggatgcggcaaattaa

SEQ ID NO: 42098 - protein, 193 aa, Neisseria meningitidis
MKHTVSASVILLLTACAQLPQNNENLWQPSEHTRSFTAEGRLAVKAEGKGSYANFDWTYQPPVETININTPLGSTLGQLCQDRDGALAVDGKGNVYQAESAEELSRQLVGFKLPIQYLHIWADGRPVAGAPYRILPDGILEQYGWTVGRTADSGGQVRTLQLNNGNLNIRLVFTEIGMPSETETQEQCAARIQ

SEQ ID NO: 42099 - DNA, 21 bp, Artificial Sequence
  Synthetic Construct
cgaatccggacggcaggactc

SEQ ID NO: 42100 - DNA, 22 bp, Artificial Sequence
  Synthetic Construct
ggcagggaatggcggattaaag

SEQ ID NO: 42101 - DNA, 20 bp, Artificial Sequence
  Synthetic Construct
aaaatgcctctccacggctg

SEQ ID NO: 42102 - DNA, 24 bp, Artificial Sequence
  Synthetic Construct
ctgcgccctgtgttaaaatcccct

SEQ ID NO: 42103 - DNA, 20 bp, Artificial Sequence
  Synthetic Construct
caaataagaaaggaattttg

SEQ ID NO: 42104 - DNA, 27 bp, Artificial Sequence
  Synthetic Construct
ggtatcgcaaaacttcgccttaatgcg

SEQ ID NO: 42105 - DNA, 21 bp, Artificial Sequence
  Synthetic Construct
cgaatccggacggcaggactc

SEQ ID NO: 42106 - DNA, 20 bp, Artificial Sequence
  Synthetic Construct
cgaccgcgcctttgggactg

SEQ ID NO: 42107 - DNA, 22 bp, Artificial Sequence
  Synthetic Construct
ggcagggaatggcggattaaag

SEQ ID NO: 42108 - DNA, 20 bp, Artificial Sequence
  Synthetic Construct
tctttgagtttgatccaacc

SEQ ID NO: 42109 - DNA, 20 bp, Artificial Sequence
  Synthetic Construct
aaaatgcctctccacggctg

SEQ ID NO: 42110 - DNA, 24 bp, Artificial Sequence
  Synthetic Construct
ctgcgccctgtgttaaaatcccct

SEQ ID NO: 42111 - DNA, 20 bp, Artificial Sequence
  Synthetic Construct
atccttccgcctcggctgcg

SEQ ID NO: 42112 - DNA, 20 bp, Artificial Sequence
  Synthetic Construct
aaaacagcggcacaatcgac

SEQ ID NO: 42113 - DNA, 20 bp, Artificial Sequence
  Synthetic Construct
ataagggctacctcaaactc

SEQ ID NO: 42114 - DNA, 20 bp, Artificial Sequence
  Synthetic Construct
gcgcgtggattatttttggg

SEQ ID NO: 42115 - DNA, 20 bp, Artificial Sequence
  Synthetic Construct
caaataagaaaggaattttg

SEQ ID NO: 42116 - DNA, 27 bp, Artificial Sequence
  Synthetic Construct
ggtatcgcaaaacttcgccttaatgcg

SEQ ID NO: 42117 - DNA, 20 bp, Artificial Sequence
  Synthetic Construct
cccaaggtaatgtagtgccg

SEQ ID NO: 42118 - DNA, 20 bp, Artificial Sequence
  Synthetic Construct
taaaaaaaagttcgacaggg

SEQ ID NO: 42119 - DNA, 20 bp, Artificial Sequence
  Synthetic Construct
ccgtccgcctgtcgtcgccc

SEQ ID NO: 42120 - DNA, 20 bp, Artificial Sequence
  Synthetic Construct
tcgttccggcggggtcgggg
